United States Patent
Williams et al.

(10) Patent No.: US 10,308,721 B2
(45) Date of Patent: Jun. 4, 2019

(54) ANTI-DLL3 ANTIBODIES AND DRUG CONJUGATES FOR USE IN MELANOMA

(71) Applicant: ABBVIE STEMCENTRX LLC, North Chicago, IL (US)

(72) Inventors: Samuel Williams, San Mateo, CA (US); Laura Saunders, San Francisco, CA (US); Kathryn A Loving, Berkeley, CA (US)

(73) Assignee: AbbVie Stemcentrx LLC, North Chicago, IL (US)

( * ) Notice: Subject to any disclaimer, the term of this patent is extended or adjusted under 35 U.S.C. 154(b) by 127 days.

(21) Appl. No.: 15/120,499

(22) PCT Filed: Feb. 23, 2015

(86) PCT No.: PCT/US2015/017171
§ 371 (c)(1),
(2) Date: Aug. 19, 2016

(87) PCT Pub. No.: WO2015/127407
PCT Pub. Date: Aug. 27, 2015

(65) Prior Publication Data
US 2017/0137533 A1 May 18, 2017

Related U.S. Application Data

(60) Provisional application No. 61/942,796, filed on Feb. 21, 2014.

(51) Int. Cl.
| | |
|---|---|
| *A61K 39/395* | (2006.01) |
| *C07K 16/18* | (2006.01) |
| *C07K 16/28* | (2006.01) |
| *C07K 16/30* | (2006.01) |
| *G01N 33/574* | (2006.01) |
| *C12Q 1/6886* | (2018.01) |
| *A61K 47/68* | (2017.01) |
| *A61K 39/00* | (2006.01) |

(52) U.S. Cl.
CPC ...... *C07K 16/3053* (2013.01); *A61K 47/6803* (2017.08); *A61K 47/6817* (2017.08); *A61K 47/6849* (2017.08); *A61K 47/6865* (2017.08); *C07K 16/28* (2013.01); *C12Q 1/6886* (2013.01); *G01N 33/5743* (2013.01); *A61K 2039/505* (2013.01); *C07K 2317/24* (2013.01); *C07K 2317/34* (2013.01); *C07K 2317/53* (2013.01); *C07K 2317/565* (2013.01); *C07K 2317/73* (2013.01); *C07K 2317/77* (2013.01); *C07K 2317/92* (2013.01); *C12Q 2600/158* (2013.01); *G01N 2333/47* (2013.01); *G01N 2800/52* (2013.01)

(58) Field of Classification Search
None
See application file for complete search history.

(56) References Cited

U.S. PATENT DOCUMENTS

| | | |
|---|---|---|
| 4,676,980 A | 6/1987 | Segal et al. |
| 4,816,567 A | 3/1989 | Cabilly et al. |
| 5,112,946 A | 5/1992 | Maione |
| 5,122,368 A | 6/1992 | Greenfield et al. |
| 5,191,066 A | 3/1993 | Bieniarz et al. |
| 5,223,409 A | 6/1993 | Ladner et al. |
| 5,336,603 A | 8/1994 | Capon et al. |
| 5,349,053 A | 9/1994 | Landolfi |
| 5,359,046 A | 10/1994 | Capon et al. |
| 5,447,851 A | 9/1995 | Beutler et al. |
| 5,530,101 A | 6/1996 | Queen |
| 5,545,806 A | 8/1996 | Lonberg et al. |
| 5,545,807 A | 8/1996 | Surani et al. |
| 5,569,825 A | 10/1996 | Lonberg et al. |
| 5,622,929 A | 4/1997 | Willner et al. |
| 5,625,126 A | 4/1997 | Lonberg et al. |
| 5,633,425 A | 5/1997 | Lonberg et al. |
| 5,648,237 A | 7/1997 | Carter |
| 5,661,016 A | 8/1997 | Lonberg et al. |
| 5,693,762 A | 12/1997 | Queen et al. |
| 5,750,373 A | 5/1998 | Garrard et al. |
| 5,824,805 A | 10/1998 | King et al. |
| 6,075,181 A | 6/2000 | Kucherlapati et al. |
| 6,150,584 A | 11/2000 | Kucherlapati et al. |
| 6,180,370 B1 | 1/2001 | Queen et al. |
| 6,214,345 B1 | 4/2001 | Firestone et al. |
| 6,300,064 B1 | 10/2001 | Knappik et al. |
| 6,362,331 B1 | 3/2002 | Kamal et al. |
| 6,376,217 B1 | 4/2002 | Better |
| 6,753,165 B1 | 6/2004 | Cox |

(Continued)

FOREIGN PATENT DOCUMENTS

| | | |
|---|---|---|
| CN | 101336300 A | 12/2008 |
| CN | 102933236 A | 2/2013 |

(Continued)

OTHER PUBLICATIONS

ADC Review: "Rovalpituzumab tesirine / Rova-T / SC16LD6.5 Drug Description," http://adcreview.com Feb. 27, 2016 Retrieved from the Internet: URL:http://adcreview.com/sc161d6-5-drug-description/.
Bjellqvist et al., "The focusing positions of polypeptides in immobilized pH gradients can be predicted from their amino acid sequences," *Electrophoresis* (1993) 14:1023-1031.
Bork et al., "The CUB domain. A widespread module in developmentally regulated proteins," *J Mol Biol.* (1993) 231(2):539-45.
Capel et al., "Heterogeneity of human IgG Fc receptors," *Immunomethods* (Feb. 1994) 4(1):25-34.

(Continued)

*Primary Examiner* — Christine J Saoud
*Assistant Examiner* — Jon M Lockard
(74) *Attorney, Agent, or Firm* — Womble Bond Dickinson (US) LLP

(57) ABSTRACT

Anti-DLL3 antibodies and antibody drug conjugates for use in the diagnosis and treatment of melanoma.

28 Claims, 32 Drawing Sheets

Specification includes a Sequence Listing.

(56) References Cited

U.S. PATENT DOCUMENTS

| | | |
|---|---|---|
| 6,982,321 B2 | 1/2006 | Winter |
| 7,049,311 B1 | 5/2006 | Thurston et al. |
| 7,087,409 B2 | 8/2006 | Barbas, III et al. |
| 7,189,710 B2 | 3/2007 | Kamal et al. |
| 7,279,554 B2 | 10/2007 | Chan et al. |
| 7,279,558 B2 | 10/2007 | Ota et al. |
| 7,407,951 B2 | 8/2008 | Thurston et al. |
| 7,422,739 B2 | 9/2008 | Anderson et al. |
| 7,429,658 B2 | 9/2008 | Howard et al. |
| 7,521,541 B2 | 4/2009 | Eigenbrot et al. |
| 7,557,099 B2 | 7/2009 | Howard et al. |
| 7,608,429 B2 | 10/2009 | Reilly |
| 7,619,068 B2 | 11/2009 | Pikington et al. |
| 7,632,678 B2 | 12/2009 | Hansford et al. |
| 7,659,241 B2 | 2/2010 | Senter et al. |
| 7,700,302 B2 | 4/2010 | Hua et al. |
| 7,723,485 B2 | 5/2010 | Junutula et al. |
| 7,741,319 B2 | 6/2010 | Howard et al. |
| 7,825,267 B2 | 11/2010 | Koide et al. |
| 7,837,980 B2 | 11/2010 | Alley |
| 7,855,275 B2 | 12/2010 | Eigenbrot |
| 8,008,443 B2 | 8/2011 | Dall'Acqua |
| 8,029,984 B2 | 10/2011 | Alitalo et al. |
| 8,034,808 B2 | 10/2011 | Delavault et al. |
| 8,053,562 B2 | 11/2011 | Humphreys |
| 8,133,857 B2 | 3/2012 | Aikawa |
| 8,163,736 B2 | 4/2012 | Gauzy et al. |
| 8,226,945 B2 | 7/2012 | Ebens |
| 8,507,654 B2 | 8/2013 | Baker |
| 8,557,965 B2 | 10/2013 | Saunders et al. |
| 8,788,213 B2 | 7/2014 | Bright et al. |
| 8,865,875 B2 | 10/2014 | Liu |
| 8,986,972 B2 | 3/2015 | Stull et al. |
| 9,089,615 B2 | 7/2015 | Stull et al. |
| 9,089,616 B2 | 7/2015 | Stull et al. |
| 9,089,617 B2 | 7/2015 | Stull et al. |
| 9,090,683 B2 | 7/2015 | Stull et al. |
| 9,107,961 B2 | 8/2015 | Stull et al. |
| 9,133,271 B1 | 9/2015 | Stull et al. |
| 9,150,664 B2 | 10/2015 | Kufer et al. |
| 9,155,803 B1 | 10/2015 | Stull et al. |
| 9,173,959 B1 | 11/2015 | Stull et al. |
| 9,334,318 B1 | 5/2016 | Stull et al. |
| 9,345,784 B1 | 5/2016 | Stull et al. |
| 9,352,051 B1 | 5/2016 | Stull et al. |
| 9,353,182 B2 | 5/2016 | Stull et al. |
| 9,358,304 B1 | 6/2016 | Stull et al. |
| 9,480,757 B2 | 11/2016 | Stull et al. |
| 9,481,727 B2 | 11/2016 | Stull et al. |
| 9,486,537 B2 | 11/2016 | Stull et al. |
| 9,683,039 B2 | 6/2017 | Aifantis et al. |
| 9,764,042 B1 | 9/2017 | Stull et al. |
| 9,770,518 B1 | 9/2017 | Stull et al. |
| 9,775,916 B1 | 10/2017 | Stull et al. |
| 9,855,343 B2 | 1/2018 | Stull et al. |
| 9,861,708 B2 | 1/2018 | Stull et al. |
| 9,867,887 B1 | 1/2018 | Stull et al. |
| 9,878,053 B2 | 1/2018 | Stull et al. |
| 9,931,420 B2 | 4/2018 | Stull et al. |
| 9,931,421 B2 | 4/2018 | Stull et al. |
| 9,937,268 B2 | 4/2018 | Stull et al. |
| 9,968,687 B2 | 5/2018 | Torgov et al. |
| 10,137,204 B2 | 11/2018 | Stull et al. |
| 2003/0180784 A1 | 9/2003 | McCarthy et al. |
| 2003/0211991 A1 | 11/2003 | Su |
| 2004/0067490 A1 | 4/2004 | Zhong et al. |
| 2004/0101920 A1 | 5/2004 | Radziejewski et al. |
| 2005/0008625 A1 | 1/2005 | Balint et al. |
| 2005/0152894 A1 | 7/2005 | Krummen |
| 2005/0238649 A1 | 10/2005 | Doronina et al. |
| 2006/0120959 A1 | 6/2006 | De Haen et al. |
| 2007/0141066 A1 | 6/2007 | Phillips et al. |
| 2007/0154889 A1 | 7/2007 | Wang |
| 2007/0292414 A1 | 12/2007 | Duntsch |
| 2008/0138313 A1 | 6/2008 | Frankel |
| 2008/0175870 A1 | 7/2008 | Mather et al. |
| 2008/0220448 A1 | 9/2008 | Blincko et al. |
| 2008/0305044 A1 | 12/2008 | McDonagh et al. |
| 2009/0010945 A1 | 1/2009 | Alley et al. |
| 2009/0130105 A1 | 5/2009 | Glaser et al. |
| 2009/0155255 A1 | 6/2009 | Glaser et al. |
| 2010/0162416 A1 | 6/2010 | Krtolica et al. |
| 2010/0184021 A1 | 7/2010 | Sella-Tavor et al. |
| 2010/0184119 A1 | 7/2010 | Bright et al. |
| 2010/0184125 A1 | 7/2010 | Huang et al. |
| 2010/0273160 A1 | 10/2010 | Donahoe et al. |
| 2010/0275280 A1 | 10/2010 | Clevers et al. |
| 2011/0020221 A1 | 1/2011 | Berman et al. |
| 2011/0033378 A1 | 2/2011 | Dimasi |
| 2011/0256157 A1 | 10/2011 | Howard et al. |
| 2011/0301334 A1 | 12/2011 | Bhakta |
| 2012/0071634 A1 | 3/2012 | Igawa et al. |
| 2012/0078028 A1 | 3/2012 | Satpayev et al. |
| 2012/0178634 A1 | 7/2012 | Sakai et al. |
| 2012/0244171 A1 | 9/2012 | Li et al. |
| 2012/0328624 A1 | 12/2012 | Yoshida et al. |
| 2013/0028919 A1 | 1/2013 | Howard et al. |
| 2013/0040362 A1 | 2/2013 | Vogel et al. |
| 2013/0058947 A1 | 3/2013 | Stull et al. |
| 2013/0061340 A1 | 3/2013 | Dylla et al. |
| 2013/0061342 A1 | 3/2013 | Dylla et al. |
| 2013/0101581 A1 | 4/2013 | Kuramochi et al. |
| 2013/0136718 A1 | 5/2013 | Chang et al. |
| 2013/0144041 A1 | 6/2013 | Dillon et al. |
| 2013/0171170 A1 | 7/2013 | Ebens, Jr. et al. |
| 2013/0259806 A1 | 10/2013 | Light |
| 2013/0260385 A1 | 10/2013 | Dylla et al. |
| 2013/0330350 A1 | 12/2013 | Dimasi |
| 2014/0106449 A1 | 4/2014 | June et al. |
| 2014/0120581 A1 | 5/2014 | Niwa |
| 2014/0127239 A1 | 5/2014 | Howard |
| 2014/0348839 A1 | 11/2014 | Chowdhury et al. |
| 2014/0363455 A1 | 12/2014 | Stull et al. |
| 2014/0363826 A1 | 12/2014 | Stull et al. |
| 2014/0363887 A1 | 12/2014 | Stull et al. |
| 2014/0364590 A1 | 12/2014 | Stull et al. |
| 2014/0364593 A1 | 12/2014 | Stull et al. |
| 2014/0370037 A1 | 12/2014 | Stull et al. |
| 2015/0005477 A1 | 1/2015 | Lowman |
| 2015/0018531 A1 | 1/2015 | Saunders et al. |
| 2015/0030636 A1 | 1/2015 | Dylla et al. |
| 2015/0265724 A1 | 9/2015 | Stull et al. |
| 2015/0320879 A1 | 11/2015 | Lyon |
| 2015/0328332 A1 | 11/2015 | Stull et al. |
| 2015/0337048 A1 | 11/2015 | Stull et al. |
| 2016/0015828 A1 | 1/2016 | Torgov et al. |
| 2016/0075779 A1 | 3/2016 | Stull et al. |
| 2016/0130331 A1 | 5/2016 | Stull et al. |
| 2016/0136296 A1 | 5/2016 | Stull et al. |
| 2016/0151513 A1 | 6/2016 | Stull et al. |
| 2016/0158379 A1 | 6/2016 | Stull et al. |
| 2016/0175460 A1 | 6/2016 | Arathoon et al. |
| 2016/0176964 A1 | 6/2016 | Arathoon et al. |
| 2016/0228571 A1 | 8/2016 | Stull et al. |
| 2017/0000901 A1 | 1/2017 | Stull et al. |
| 2018/0055944 A1 | 3/2018 | Lu et al. |
| 2018/0318441 A1 | 11/2018 | Torgov et al. |

FOREIGN PATENT DOCUMENTS

| | | |
|---|---|---|
| EP | 0307434 | 3/1989 |
| EP | 0367166 | 5/1990 |
| EP | 2530091 A1 | 12/2012 |
| JP | 58-180487 | 10/1983 |
| JP | 2008-521828 A | 6/2008 |
| JP | 2009-523709 A | 6/2009 |
| JP | 2010-173975 A | 8/2010 |
| JP | 2011-516520 A | 5/2011 |
| JP | 2016-030269 | 5/2016 |
| WO | WO 91/00360 | 1/1991 |
| WO | WO 91/06570 | 5/1991 |
| WO | WO 91/17271 | 11/1991 |
| WO | WO 92/00373 | 1/1992 |
| WO | WO 92/01047 | 1/1992 |

(56) References Cited

FOREIGN PATENT DOCUMENTS

| | | |
|---|---|---|
| WO | WO 92/09690 | 6/1992 |
| WO | WO 92/15679 | 9/1992 |
| WO | WO 92/18619 | 10/1992 |
| WO | WO 92/20791 | 11/1992 |
| WO | WO 93/01288 | 1/1993 |
| WO | WO 94/04690 | 3/1994 |
| WO | WO 96/04388 | 2/1996 |
| WO | WO 96/07754 | 3/1996 |
| WO | WO 96/27011 | 9/1996 |
| WO | WO 97/33899 | 9/1997 |
| WO | WO 97/34911 | 9/1997 |
| WO | WO 98/52976 | 11/1998 |
| WO | WO 99/37779 | 1/1999 |
| WO | WO 99/23105 | 5/1999 |
| WO | WO 00/34317 | 6/2000 |
| WO | WO 01/12664 | 2/2001 |
| WO | WO 01/83552 | 11/2001 |
| WO | WO 02/14358 | 2/2002 |
| WO | WO 03/048731 | 6/2003 |
| WO | WO 03/075957 | 9/2003 |
| WO | WO 2004/035537 | 4/2004 |
| WO | WO 2005/003171 A2 | 7/2004 |
| WO | WO 2006/034488 A2 | 9/2005 |
| WO | WO 2006/065533 A2 | 6/2006 |
| WO | WO 2006/119062 A2 | 11/2006 |
| WO | WO 2006/134173 | 12/2006 |
| WO | WO 2007/080597 A2 | 7/2007 |
| WO | WO 2007/085930 | 8/2007 |
| WO | WO 2007/111733 A2 | 10/2007 |
| WO | WO 2008/047925 A1 | 4/2008 |
| WO | WO 2009/052249 A1 | 4/2009 |
| WO | WO 2009/079587 | 6/2009 |
| WO | WO 2009/124931 A2 | 10/2009 |
| WO | WO 2010/056337 | 5/2010 |
| WO | WO 2010/096574 | 8/2010 |
| WO | WO 2011/093097 A1 | 8/2011 |
| WO | WO 2011/128650 | 10/2011 |
| WO | WO 2011/130598 | 10/2011 |
| WO | WO 2011/130613 | 10/2011 |
| WO | WO 2011/130616 | 10/2011 |
| WO | WO 2012/064733 A2 | 11/2011 |
| WO | WO 2012/012801 | 1/2012 |
| WO | WO 2012/031280 | 3/2012 |
| WO | WO 2012/047724 A1 | 4/2012 |
| WO | WO 2012/078761 | 6/2012 |
| WO | WO 2012/103455 | 8/2012 |
| WO | WO 2012/128801 | 9/2012 |
| WO | WO 2013/093809 | 12/2012 |
| WO | WO 2013/006495 | 1/2013 |
| WO | WO 2013/041606 | 3/2013 |
| WO | WO 2013/053873 | 4/2013 |
| WO | WO 2013/055987 | 4/2013 |
| WO | WO 2013/119960 | 8/2013 |
| WO | WO 2013/119964 | 8/2013 |
| WO | WO 2013/126746 A2 | 8/2013 |
| WO | WO 2013/126810 | 8/2013 |
| WO | WO 2013/134658 | 9/2013 |
| WO | WO 2014/057072 | 4/2014 |
| WO | WO 2014/057074 | 4/2014 |
| WO | WO 2014/124316 A2 | 7/2014 |
| WO | WO 2014/125273 | 8/2014 |
| WO | WO 2014/130879 | 8/2014 |
| WO | WO 2015/123265 | 2/2015 |
| WO | WO 2015/031541 A1 | 3/2015 |
| WO | WO 2015/031693 | 3/2015 |
| WO | WO 2015/031698 | 3/2015 |
| WO | WO 2015/052532 | 4/2015 |
| WO | WO 2015/052533 | 4/2015 |
| WO | WO 2015/052534 | 4/2015 |
| WO | WO 2015/052535 | 4/2015 |
| WO | WO 2015/127407 | 8/2015 |
| WO | WO 2016/064749 | 4/2016 |

OTHER PUBLICATIONS

Carrodus, N.L., et al., "Seizure-Related Gene 6: A Modulator of Excitatory Synapse Development," Australian Neuroscience Society Annual Meeting, Auckland (Jan. 31-Feb. 3, 2011) p. 87.

Gene Cards, "SEZ6 Gene" definition; pp. 1-14(Jan. 15, 2016).

Herbst et al., "SEZ-6: promoter selectivity, genomic structure and localized expression in the brain," Brain Res Mol Brain Res. (Mar. 1997) 44(2):309-22 PMID: 9073173.

Huynh et al., "The Novel Gamma Secretase Inhibitor RO4929097 Reduces the Tumor Initiating Potential of Melanoma," Sep. 2011, PLoS ONE, vol. 6, No. 9, p. e25264 XP55233585.

Iishikawa et al., "Characterization of SEZ6L2 cell-surface protein as a novel prognostic marker for lung cancer," Cancer Sci. (Aug. 2006) 97(8):737-45.

Masterson et al., "Synthesis and biological evaluation of novel pyrrolo[2,1-c][1,4]benzodiazepine prodrugs for use in antibody-directed enzyme prodrug therapy," Bioorg Med Chem Lett. (Jan. 15, 2006) 16(2):252-6. Epub Nov. 15, 2005.

Mulley et al., "The Role of Seizure-Related SEZ6 as a Susceptibility Gene in Febrile Seizures," Neurol Res Int (2011) 2011:917565 PMID: 21785725.

NCBI protein database search ("human seizure related 6 homologue" or "SEZ6") and (Homo sapiens)) (pp. 1-2, Jun. 3, 2016).

NM_001098635—Homo sapiens seizure related 6 homolog (SEZ6), transcript variant 2, Mrna.

NM_178860—Homo sapiens seizure related 6 homolog (SEZ6), transcript variant 1, mRNA.

NP_001092105—seizure protein 6 homolog isoform 2 precursor [Homo sapiens].

NP_001099224—seizure protein 6 homolog precursor [Rattus norvegicus].

NP_001139913—synaptojanin-1 [Salmo salar].

NP_067261—seizure protein 6 isoform 1 precursor [Mus musculus].

NP_849191.3—seizure protein 6 homolog isoform 1 precursor [Homo sapiens].

Osaki et al., "The distribution of the seizure-related gene 6 (Sez-6) protein during postnatal development of the mouse forebrain suggests multiple functions for this protein: An analysis using a new antibody," Brain Research (Feb. 10, 2011), 1386:58-69, XP028186555.

Perez-Moreno et al., "Sticky business: Orchestrating Cellular Signals at Adherens Junctions," Cell (Feb. 21, 2003) 112:535-548.

Ravetch et al., "Fc receptors," Annu Rev Immunol. (1991) 9:457-92.

Roitt I., et al., Immunology, Moscow, Mir (2000) 592 pages, pp. 110-111.

Rybko, V.A., et al., "Role of Notch signaling in tumorigenesis: multiple mechanisms and therapeutic potential," Basic research and clinical practice 2011, 4(2): 103-110, the whole document Russian language with English Abstract.

Saunders et al., "A DLL3-targeted antibody-drug conjugate eradicates high-grade pulmonary neuroendocrine tumor-initiating cells in vivo," Sci Transl Med. (Aug. 26, 2015) 7(302):302ra136. doi: 10.1126/scitranslmed.aac9459.

Schalper et al., "Programmed death-1/programmed death-1 ligand axis as a therapeutic target in oncology: current insights," Journal of Receptor, Ligand and Channel Research ePub (Dec. 23, 2014) 8: 1-7.

Schildbach, J.F., et al., "Modulation of antibody affinity by a non-contact residue," Protein Sci (1993) 2:206-214.

Shimizu-Nishikawa, K., et al., "Cloning and expression of SEZ-6, a brain-specific and seizure-related cDNA," Brain Res Mol Brain Res. (Feb. 1995) 28(2):201-10 PMID 7723619.

Spigel et al., "Rationale for chemotherapy, immunotherapy, and checkpoint blockade in SCLC: beyond traditional treatment approaches," J Thorac Oncol. (May 2013) 8(5):587-98. doi: 10.1097/JTO.0b013e318286cf88.

Vermeer et al., "The thermal stability of immunoglobulin: unfolding and aggregation of a multi-domain protein," Biophys J. (Jan. 2000) 78(1):394-404.

(56) References Cited

OTHER PUBLICATIONS

Vermeer et al., "The unfolding/denaturation of immunogammaglobulin of isotype 2b and its F(ab) and F(c) fragments," *Biophys. J.* (2000) 79(4): 2150-2154 PMID: 11023918.

Waldmann et al., "Microarray analysis reveals differential expression of benign and malignant pheochromocytoma," *Endocr. Relat. Cancer* (2010) 17(3):743-56.

XP_511368—PREDICTED: seizure protein 6 homolog isoform X2 [Pan troglodytes].

XP002767506, "Phase I/II Open Label Dose Escalation Study of the Safety, Pharmacokinetics, and Preliminary Efficacy of SC16LD6.5 as a Single Agent in Patients With Recurrent Small Cell Lung Cancer," Clinical Trials.gov archive, URL:https://clinicaltrials.gov/archive/NCT01901653/2013_08_20, Aug. 20, 2013.

Yu, Z.L., et al., "Febrile seizures are associated with mutation of seizure-related (SEZ) 6, a brain-specific gene," *J Neurosci Res.* (2007) 85:166-72 PMID: 17086543.

Official action dated Dec. 20, 2017, issued in Chilean application (No. 02105-2016).

Official action dated Mar. 27, 2018, issued in Colombian application (No. NC2016/0001859).

Extended search report dated Jun. 26, 2017, in European application (No. 14839261.6).

Extended search report dated Aug. 7, 2017, in European application (No. 15752054.5).

Official action dated Apr. 3, 2018, issued in European application (No. 15752054.5).

Official action dated Aug. 2, 2017, issued in Thai application (No. 1601004784).

Antonow and Thurston, "Synthesis of DNA-interactive pyrrolo[2,1-c][1,4]benzodiazepines (PBDs)," *Chem. Rev.* (2011) 111(4):2815-2864.

Apelqvist, A., et al., "Notch signalling controls pancreatic cell differentiation," *Nature* (1999) 400(6747):877-81.

Arima et al., "Studies on tomaymycin, a new antibiotic. I. Isolation and properties of tomaymycin," *J Antibiot* (Tokyo) (1972) 25(8):437-44.

Ashkenazi et al., "Protection against endotoxic shock by a tumor necrosis factor receptor immunoadhesin," *Proc Natl Acad Sci USA* (1991) 88(23):10535-9.

Ayyanan, A., et al., "Increased Wnt signaling triggers oncogenic conversion of human breast epithelial cells by Notch-dependent mechanism," *Proceedings of theNational Academy of Sciences of USA* (2006) 103(10):3799-3804.

Ball, "Achaete-scute homolog-1 and Notch in lung neuroendocrine development and cancer," *Cancer Letters*, 2004, 204(2):159-69.

Barabas et al., "Assembly of combinatorial antibody libraries on phage surfaces: the gene III site," *Proc. Natl. Acad. Sci.* USA 88:7978-7982 (1991).

Bertolotto C., "Melanoma: From melanocyte to genetic alterations and clinical options," *Scientifica.* (2013) 2013:1-22.

Bigas A and Espinosa L, "Hematopoietic stem cells: to be or Notch to be," *Blood* (Apr. 5, 2012) 119(14):3226-35.

Boerner et al.,"Production of antigen-specific human monoclonal antibodies from in vitro-primed human splenocytes," *J Immunol.* (Jul. 1, 1991) 147(1):86-95—Abstract.

Bose et al., "New approaches to pyrrolo[2,1-c][1,4]benzodiazepines: synthesis, DNA-binding and cytotoxicity of DC-81," *Tetrahedron*, (1992) 48:751-58.

Boswell et al., "An integrated approach to identify normal tissue expression of targets for antibody-drug conjugates: case study of TENB2," *British Journal of Pharmacology* (2013) 168:445-457.

Carter, P., "Potent antibody therapeutics by design," *Nat Rev Immunol.* (2006) 6(5):343-57.

Chao et al., "Isolating and engineering human antibodies using yeast surface display." *Nat Protoc.* (2007) 1(2):755-68 PMID: 17406305.

Chapman, G., et al., "Notch inhibition by the ligand DELTA-LIKE 3 defines the mechanism of abnormal vertebral segmentation in spondylocostal dysostosis," *Hum Mol Genet.* (Mar. 1, 2011) 20(5):905-16.

Chen, H., et al., "Conservation of the *Drosophila* lateral inhibition pathway in human lung cancer: a hairy-related protein (HES-1) directly represses achaete-scute homolog-1 expression," *Proc Nati Acad Sci USA* (1997) 94:5355-60, PMID: 9144241.

Chothia et al., "Canonical structures for the hypervariable regions of immunoglobulins," *J Mol Biol.* (1987) 196(4):901-17.

Chothia et al., "Conformations of immunoglobulin hypervariable regions," *Nature* (1989) 342(6252):877-83.

Chothia, D., et al., "Structural repertoire of the human VH segments," *J Mol Biol.* (Oct. 5, 1992) 227(3):799-817—Abstract.

Chumsae et al., "Identification and localization of unpaired cysteine residues in monoclonal antibodies by fluorescence labeling and mass spectrometry," *Anal Chem.* (2009), 81(15):6449-57.

Cochran et al., "Domain-level antibody epitope mapping through yeast surface display of epidermal growth factor receptor fragments," *J Immunol Methods.* (Apr. 2004) 287(1-2):147-58.

Cook, G. P., et al., "The human immunoglobulin VH repertoire." *Immunol Today* (May 16, 1995) (5):237-42—Abstract.

Cook M et al., "Notch in the development of thyroid C-cells and the treatment of medullary thyroid cancer," *Am J Transl Res.* (Feb. 10, 2010) 2(1):119-25.

Davies et al., "Mutations of the BRAF gene in human cancer," *Nature* (2002) 417:949-54.

De La Pompa JL et al., "Conservation of the Notch signaling pathway in mammalian neurogenesis," *Development* (Mar. 1997) 124(6):1139-48.

Denardo et al., "Comparison of 1,4,7,10-tetraazacyclododecane-N,N',N'',N'''-tetraacetic acid (DOTA)-peptide-ChL6, a novel immunoconjugate with catabolizable linker, to 2-iminothiolane-2-[p-(bromoacetamido)benzyl]-DOTA-ChL6 in breast cancer xenografts," *Clin Cancer Res.* (Oct. 1998) 4(10):2483-90.

DLL3 Aptamer Presentation, "Aptamer Technology for Cell-Specific Cancer Therapy," *Academia Sinica* (Jul. 7, 2010).

Dornan et al., "Therapeutic potential of an anti-CD79b antibody-drug conjugate, anti-CD79b-vc-MMAE, for the treatment of non-Hodgkin lymphoma," *Blood* (2009) 114(13):2721-9.

Doronina et al., "Enhanced activity of monomethylauristatin F through monoclonal antibody delivery: effects of linker technology on efficacy and toxicity," *Bioconjug Chem.* (2006) 17(1):114-24.

D'Souza Brendan et al., "Canonical and non-canonical Notch ligands," *Curr Top Dev Biol.* (2010) 92:73-129.

Dubowchik et al., "Cathepsin 6-labile dipeptide linkers for lysosomal release of doxorubicin from internalizing immunoconjugates: model studies of enzymatic drug release and antigen-specific in vitro anticancer activity," *Bioconjug Chem.* (Jul.-Aug. 2002) 13(4):855-69.—Abstract.

Dunwoodie, S.L., "The role of Notch in patterning the human vertebral column," *Curr Opin Genet Dev.* (2009) 19(4):329-37.

Dunwoodie et al., "Mouse Dll3: a novel divergent Delta gene which may complement the function of other Delta homologues during early pattern formation in the mouse embryo," *Development* (Aug. 1997) 124(16):3065-76.

Dutta, S., et al., "Notch signaling regulates endocrine cell specification in the zebrafish anterior pituitary," *Dev Biol.* (Jul. 15, 2008) 319(2):248-57.

Dylla et al., "Colorectal cancer stem cells are enriched in xenogeneic tumors following chemotherapy," *PLoS One* (Jun. 18, 2008) 3(6):e2428.

Edlundh-Rose et al., "NRAS and BRAF mutations in melanoma tumours in relation to clinical characteristics: a study based on mutation screening by pyrosequencing." *Melanoma Res.* (2006) 16(6):471-8 PMID: 17119447.

Erickson et al., "Antibody-maytansinoid conjugates are activated in targeted cancer cells by lysosomal degradation and linker-dependent intracellular processing," *Cancer Res.* (2006) 66(8):4426-33.

Fre, S., et al., "Notch signals control the fate of immature progenitor cells in the intestine," *Nature* (Jun. 16, 2005) 435(7044):964-8.

(56) References Cited

OTHER PUBLICATIONS

Fre, S., et al., "Notch and Wnt signals cooperatively control cell proliferation and tumorigenesis in the intestine," *Proc Natl Acad Sci U S A.* (Apr. 14, 2009) 106(15):6309-14.
Fuhrmann, S., et al., "Abstract 5625: In vitro and in vivo pharmacology of MEDI-565 (MT111), a novel CEA/CD3-bispecific single-chain BiTE antibody in development for the treatment of gastrointestinal adenocarcinomas," *Cancer Research:* (Apr. 15, 2010) 70(8), Supplement 1.
Galluzzo, P., and Bocchetta, M., "Notch signaling in lung cancer," *Expert Rev Anticancer Ther.* (Apr. 2011) 11(4):533-40.
Garnett, M.C., "Targeted drug conjugates: principles and progress," *Adv Drug Deliv Rev.* (Dec. 17, 2001) 53(2):171-216.
Geffers, I., et al., "Divergent functions and distinct localization of the Notch ligands DLL1 and DLL3 in vivo," *J Cell Biol.* (Jul. 30, 2007) 178(3):465-76.
Glittenberg, M., et al., "Role of conserved intracellular motifs in Serrate signalling, cis-inhibition and endocytosis," *EMBO J.* (Oct. 18, 2006) 25(20):4697-706, Epub Sep. 28, 2006.
Goldbeter, A., and Pourquié, O., "Modeling the segmentation clock as a network of coupled oscillations in the Notch, Wnt and FGF signaling pathways," *J Theor Biol.* (Jun. 7, 2008) 252(3):574-85.
Gregson et al., "Synthesis of a novel C2/C2'-exo unsaturated pyrrolobenzodiazepine cross-linking agent with remarkable DNA binding affinity and cytotoxicity," *Chem. Commun.* (1999) 9:797-798.
Gregson et al., "Design, synthesis, and evaluation of a novel pyrrolobenzodiazepine DNA-interactive agent with highly efficient cross-linking ability and potent cytotoxicity," *J Med Chem.* (2001) 44(5):737-48.
Habener, J.F., et al., "Minireview: transcriptional regulation in pancreatic development," *Endocrinology* (2005) 146(3):1025-34, Epub Dec. 16, 2004.
Hamann, P., "Monoclonal antibody-drug conjugates," *Expert Opin Ther Patents*, (2005) 15(9):1087-1103.
Hamblett et al., "Effects of drug loading on the antitumor activity of a monoclonal antibody drug conjugate," *Clin Cancer Res.* (2004) 10(20):7063-70.
Hara et al., "DC 102, a new glycosidic pyrrolo(1,4)benzodiazepine antibiotic produced by Streptomyces sp," *J Antibiot* (Tokyo) (1988) 41(5):702-4.
Harris, P.J., et al., "Targeting embryonic signaling pathways in cancer therapy," *Expert Opin Ther Targets* (2012) 16(1):131-45.
Henke, R.M., et al., "Ascl1 and Neurog2 form novel complexes and regulate Delta-like3 (DLL3) expression in the neural tube," *Dev Biol.* (2009) 328(2):529-40.
Hochleitner et al., "Characterization of a discontinuous epitope of the human immunodeficiency virus (HIV) core protein p24 by epitope excision and differential chemical modification followed by mass spectrometric peptide mapping analysis," *Protein Sci.* (Mar. 2000) 9(3):487-96.
Hochlowski et al., "Abbeymycin, a new anthramycin-type antibiotic produced by a streptomycete," *J Antibiot (Tokyo).* (1987) 40(2):145-8.
Hoey et al., "DLL4 blockade inhibits tumor growth and reduces tumor-initiating cell frequency," *Cell Stem Cell.* (2009) 5(2):168-77.
Hoyne G.F., et al., "A cell autonomous role for the Notch ligand Delta-like 3 in αβ T-cell development," *Immunol Cell Biol.* (2011) 89(6):696-705.
Huber K et al., "Development of chromaffin cells depends on MASH1 function," *Development* (2002) 129(20):4729-38.
Huff, Carol Ann, et al., "Strategies to eliminate cancer stem cells: Clinical implications," *European Journal of Cancer*, 42 (2006) 1293-1297.
Hurley and Needham-Vandevanter, "Covalent binding of antitumor antibiotics in the minor groove of DNA. Mechanism of action of CC-1065 and the pyrrolo(1,4)benzodiazepines," *Acc. Chem. Res.* (1986) 19 (8): 230-237.
Ito, T., et al., "Basic helix-loop-helix transcription factors regulate the neuroendocrine differentiation of fetal mouse pulmonary epithelium," *Development* (Sep. 2000) 127(18):3913-21.
Itoh et al., "Sibanomicin, a new pyrrolo[1,4]benzodiazepine antitumor antibiotic produced by a *Micromonospora* sp," *J Antibiot* (Tokyo) (1988) 41(9):1281-4.
Ivan and Prieto, "Use of immunohistochemistry in the diagnosis of melanocytic lesions: applications and pitfalls." *Future Oncol.* (2010) 6(7):1163-75 PMID: 20624128.
Jeffrey et al., "Design, synthesis, and in vitro evaluation of dipeptide-based antibody minor groove binder conjugates," *J Med Chem.* (2005) 48(5):1344-58.
Jensen, J., et al., "Control of endodermal endocrine development by Hes-1," *Nat Genet.* (2000) 24(1):36-44.
Jones et al., "Replacing the complementarity-determining regions in a human antibody with those from a mouse," *Nature* (1986) 4; 321(6069):522-5—Abstract.
Junutula et al., "Site-specific conjugation of a cytotoxic drug to an antibody improves the therapeutic index," Nat Biotechnol. (2008) 26(8):925-32.
Kageyama, R., et al., "Oscillator mechanism of Notch pathway in the segmentation clock," *Dev Dyn.* (2007) 236(6):1403-9.
Kameda, Y., et al., "Mash1 regulates the development of C cells in mouse thyroid glands." *Dev Dyn.* (Jan. 2007), 236(1):262-70.
Klein, T., et al., "An intrinsic dominant negative activity of serrate that is modulated during wing development in *Drosophila*," *Dev Biol.* (Sep. 1, 1997) 189(1):123-34.
Klimstra, D.S., et al., "The pathologic classification of neuroendocrine tumors: a review of nomenclature, grading, and staging systems," *Pancreas.* (Aug. 2010) 39(6):707-12.
Klöppel, G., "Classification and pathology of gastroenteropancreatic neuroendocrine neoplasms. Endocr Relat Cancer," *Endocr Relat Cancer.* (2011) 18 Suppl 1:S1-16.
Koch, U., and Radtke, F., "Notch signaling in solid tumors," *Curr Top Dev Biol.* (2010) 92:411-55.
Kohn, "Anthramycin," In Antibiotics III. Springer-Verlag, New York, (1975) pp. 3-11.
Konishi et al., "Chicamycin, a new antitumor antibiotic. II. Structure determination of chicamycins A and B," *J Antibiot* (Tokyo) (1984) 37(3):200-6.
Kovtun et al., "Antibody-drug conjugates designed to eradicate tumors with homogeneous and heterogeneous expression of the target antigen," *Cancer Res.* (2006) 66(6):3214-21.
Kroesen, B.J., et al., "Approaches to lung cancer treatment using the CD3 x EGP-2-directed bispecific monoclonal antibody BIS-1," *Cancer Immunol Immunother.* (1997) 45(3-4):203-6.
Kudchadkar et al., "New Targeted Therapies for Melanoma," *Cancer Control* (2013) 20(4):282-288.
Kunimoto et al., "Mazethramycin, a new member of anthramycin group antibiotics," *J Antibiot* (Tokyo) (1980) 33(6):665-7.
Kusumi, K., et al. "The mouse pudgy mutation disrupts Delta homologue DLL3 and initiation of early somite boundaries," *Nat Genet.* (1988) 19(3):274-8.
Ladi, E., et al., "The divergent DSL ligand Dll3 does not activate Notch signaling but cell autonomously attenuates signaling induced by other DSL ligands," *J Cell Biol.* (2005) 170(6):983-92.
Lambert, J., et al., "Drug-conjugated monoclonal antibodies for the treatment of cancer," *Curr Opin Pharmacol.* (2005) 5(5):543-9.
Langley and Thurston, "A versatile and efficient synthesis of carbinolamine-containing pyrrolo[1,4]benzodiazepines via the cyclization of N-(2-aminobenzoyl)pyrrolidine-2-carboxaldehyde diethyl thioacetals: total synthesis of prothracarcin," *J Org Chem.* (1987) 52, 91-97.
Law et al., "Lymphocyte activation antigen CD70 expressed by renal cell carcinoma is a potential therapeutic target for anti-CD70 antibody-drug conjugates," *Cancer Res.* (2006) 66(4):2328-37.
Leber et al., "A revised structure of sibiromycin," *J. Am. Chem. Soc.*, (1988) 110 (9):2992-2993.
Leimgruber et al., "Isolation and characterization of anthramycin, a new antitumor antibiotic," *J. Am. Chem. Soc.* (1965) 87(24): 5791-93.
Leimgruber et al., "The structure of anthramycin," *J. Am. Chem. Soc.* (1965) 87(24):5793-95.

(56) References Cited

OTHER PUBLICATIONS

Linos et al., "Melanoma update: diagnostic and prognostic factors that can effectively shape and personalize management." (2011) *Biomark Med.* 5(3):333-60 PMID: 21657842.

Liu, J., et al., "Notch signaling in the regulation of stem cell self-renewal and differentiation," *Curr Top Dev Biol.* (2010) 92:367-409.

Lonberg et al., "Human antibodies from transgenic mice," *Int Rev Immunol.* (1995) 13(1):65-93—Abstract.

Maccallum et al., "Antibody-antigen interactions: contact analysis and binding site topography," *J Mol Biol.* (1996) 262(5):732-45.

Maemura, Kentaro, et al., "Delta-like 3 is silenced by methylation and induces apoptosisin human hepatocellular carcinoma," *Int J Oncol.* (2013) 42(3): 817-822.

Marks et al., "By-passing immunization: building high affinity human antibodies by chain shuffling," *Biotechnology* (N Y). (1992) 10(7):779-783—Abstract.

McDonagh et al., "Engineered antibody-drug conjugates with defined sites and stoichiometries of drug attachment," *Protein Eng Des Sel.* (2006) 19(7):299-307.

Millipore, "Anti-Delta3, clone 1E7.2," (Jul. 15, 2008) pp. 1-3 (XP002697359).

Milstein et al., "Hybridomas and their use in immunohistochemistry," *Nature*, (1983) 305:537-539—Abstract.

Morrison et al., "Chimeric human antibody molecules: mouse antigen-binding domains with human constant region domains," *Proc Natl Acad Sci U S A.* (1984) 81(21):6851-5.

Nagase, H., et al., "γ-Secretase-regulated signaling pathways, such as notch signaling, mediate the differentiation of hematopoietic stem cells, development of the immune system, and peripheral immune responses," *Curr Stem Cell Res Ther.* (2011) 6(2):131-41.

Panowski, S., et al., "Site-specific Antibody Drug Conjugates for Cancer Therapy," *MAbs* (Jan.-Feb. 2014) 6(1):34-35.

Payne, G., "Progress in immunoconjugate cancer therapeutics," *Cancer Cell.* (2003) 3(3):207-12.

Peterson et al., "Enzymatic cleavage of peptide-linked radiolabels from immunoconjugates," *Bioconjug Chem.* (1999) 10(4):553-7.

Press News Release, AbbVie and Bristol-Myers Squibb Oncology Clincal Collaboration with Rova-T (Jul. 25, 2016).

Prunotto et al., "Proteomic analysis of podocyte exosome-enriched fraction from normal human urine." *J Proteomics.* (2013) 82:193-229.

R&D Systems: "Human DLL3 Antibody Monoclonal Mouse IgG2B Clone #378703, Catalog No. MA4315" (May 5, 2010) pp. 1-1, (XP002697358).

Raetzman, L.T., et al., "Developmental regulation of Notch signaling genes in the embryonic pituitary: Prop1 deficiency affects Notch2 expression," *Dev Biol.* (2004) 265(2):329-40.

Rebay I, et al., "Specific EGF repeats of Notch mediate interactions with Delta and Serrate: implications for Notch as a multifunctional receptor," *Cell.* (Nov. 15, 1991) 67(4):687-99.

Reineke, U., "Antibody epitope mapping using arrays of synthetic peptides," *Methods Mol Biol.* (2004) 248:443-63.

Retter et al., "VBASE2, an integrative V gene database," *Nucleic Acids Res.* (Jan. 1, 2005) 33 (Database issue):D671-4.

Robine, S., et al., "Notch signals control the fate of immature progenitor cells in the intestine," *Med Sci* (Paris) (Aug.-Sep. 2005) 21(8-9):780-2.

Rodrigues, M. L., et al., "Engineering Fab' Fragments for Efficient F(ab)2 Formation in *Escherichia coli* and for Improved In Vivo Stability," *The Journal of Immunology*, Dec. 15, 1993, 151(12): 6954-6961.

Rothberg et al., "Tissue biomarkers for prognosis in cutaneous melanoma: A systematic review and meta-analysis," *J Natl Cancer Inst.* (2009) 101:452-74.

Sakamoto, K., et al., "Intracellular cell-autonomous association of Notch and its ligands: a novel mechanism of Notch signal modification," *Dev Biol.* (Jan. 15, 2002) 241(2):313-26, PMID: 11784114.

Sanderson et al., "In vivo drug-linker stability of an anti-CD30 dipeptide-linked auristatin immunoconjugate," *Clin Cancer Res.* (2005) 11(2 Pt 1):843-52.

Schonhoff, S.E., et al., "Minireview: Development and differentiation of gut endocrine cells," *Endocrinology.* (Jun. 2004) 145(6):2639-44.

Schulenburg et al., "Neoplastic stem cells: current concepts and clinical perspectives," *Crit Rev Oncol Hematol.* (Nov. 2010) 76(2):79-98.

Sebastian, Martin, et al., "Treatment of non-small cell lung cancer patients with the trifunctional monoclonal antibody catumaxomab (anti-EpCAM x anti-CD3): a phase I study," *Cancer Immunol Immunother.* (2007) 56(10):1637-44. Epub (Apr. 5, 2007).

Sheets et al., "Efficient construction of a large nonimmune phage antibody library: the production of high-affinity human single-chain antibodies to protein antigens," *Proc Natl Acad Sci U S A.* (1998) 95(11):6157-62.

Shimizu et al., "Prothracarcin, a novel antitumor antibiotic," *J Antibiotics*, (1982) 29:2492-2503.

Shimizu, K., et al., "Mouse jagged1 physically interacts with notch2 and other notch receptors. Assessment by quantitative methods," *J Biol Chem.* (Nov. 12, 1999) 274(46):32961-9.

Shinkai Y et al., "New mutant mouse with skeletal deformities caused by mutation in delta like 3 (DLL3) gene," *Exp Anim.* (Apr. 2004) 53(2):129-36.

Sprinzak, D., et al., "Cis-interactions between Notch and Delta generate mutually exclusive signalling states," *Nature* (May 6, 2010) 465(7294):86-90.

Sriuranpong, V., et al., "Notch signaling induces rapid degradation of achaete-scute homolog 1," *Mol Cell Biol.* (2002) 22(9):3129-39.

Sternberg, P.W., "Lateral inhibition during vulval induction in Caenorhabditis elegans." *Nature* (1988) 335(6190):551-4.

Strop, P., et al., "Location Matters: Site of Conjugation Modulates Stability and Pharmacokinetics of Antibody Drug Conjugates," *Chemistry & Biology*, Feb. 21, 2013, 20:161-167.

Sun, M., et al., "Reduction-Alkylation Strategies for the Modification of Specific Monoclonal Antibody Disulfides," *Bioconug. Chem.* (2005) 16(5): 1282-1290.

Sussman, D., et al., Abstract 4634, "Engineered Cysteine Drug Conjugates Show Potency and Improved Safety," *Cancer Research*, Apr. 15, 2012, 72(8), Supp. 1.

Syrigos and Epenetos, "Antibody directed enzyme prodrug therapy (ADEPT): a review of the experimental and clinical considerations," *Anticancer Res.* (1999) 19(1A):605-13.

Takahashi et al., "Human Fas ligand: gene structure, chromosomal location and species specificity." *International Immunology*, (1994) vol. 6, No. 10, pp. 1567-1574; PMID 7826947.

Takeuchi et al., "Neothramycins A and B, new antitumor antibiotics," *J Antibiot* (Tokyo) (1976) 29(1):93-6.

Thomas et al., "Tandem BRAF Mutations in Primary Invasive Melanomas." *J Invest Dermatol.* (2004) 122:1245-50.

Thomas et al., "Number of nevi and early-life ambient UV exposure are associated with BRAF-mutant melanoma." *Cancer Epidemiol Biomarkers Prev.* (2007) 16(5):991-7.

Thurston et al., "The Molecular Recognition of DNA," *Chem. Brit.* (1990) 26:767-772.

Thurston et al., "Synthesis of DNA-Interactive Pyrrolo[2,1-c][1,4]benzodiazepines," *Chem. Rev.* (1994) 94(2):433-465.

Tomlinson et al., "The repertoire of human germline VH sequences reveals about fifty groups of VH segments with different hypervariable loops," *Mol Biol.* (Oct. 5, 1992) 227(3):776-98—Abstract.

Tomlinson et al., "The structural repertoire of the human V kappa domain." *EMBO J.* (Sep. 15, 1995) 14(18):4628-38.

Trail et al., "Monoclonal antibody drug immunoconjugates for targeted treatment of cancer," *Cancer Immunol Immunother.* (2003) 52(5):328-37.

Tsunakawa et al., "Porothramycin, a new antibiotic of the anthramycin group: production, isolation, structure and biological activity," *J Antibiot* (Tokyo) (1988) 41(10):1366-73.

Turnpenny, P.D., et al., "A gene for autosomal recessive spondylocostal dysostosis maps to 19q13.1-q13.3," *Am J Hum Genet.* (Jul. 1999) 65(1):175-82.

(56) References Cited

OTHER PUBLICATIONS

Umetsu, M., et al., "How Additives Influence the Refolding of Immunoglobulin-folded Proteins in a Stepwise Dialysis System: Spectroscopic Evidence for Highly Efficient Refolding of a Single-chain FV Fragment," *J. Biol. Chem.*, Mar. 14, 2003, 278(11): 8979-8987.
Vaughan et al., "Human antibodies with sub-nanomolar affinities isolated from a large non-immunized phage display library," *Nature Biotechnol.* (Mar. 1996) 14(3):309-14—Abstract.
Vié et al., "Human fusion proteins between interleukin 2 and IgM heavy chain are cytotoxic for cells expressing the interleukin 2 receptor," *Proc Natl Acad Sci U S A.* (Dec. 1, 1992) 89(23):11337-41.
Visvader et al., "Cancer stem cells in solid tumours: accumulating evidence and unresolved questions," *Nat Rev Cancer.* (Oct. 2008) 8(10):755-68.
Wharton, K.A., et al., "Nucleotide sequence from the neurogenic locus notch implies a gene product that shares homology with proteins containing EGF-like repeats," *Cell* (Dec. 1985) 43(3 Pt 2):567-81.
Wu et al., "Arming antibodies: prospects and challenges for immunoconjugates," *Nat Biotechnol.* (2005) 23(9):1137-46.
Wu et al., "Adoptive T-cell Therapy Using Autologous Tumor-infiltrating Lymphocytes for Metastatic Melanoma: Current Status and Future Outlook," *Cancer J.* (2012) 18(2):160-175.
Xie et al., "In vivo behaviour of antibody-drug conjugates for the targeted treatment of cancer," *Expert Opin Biol Ther.* (2006) 6(3):281-91.
Xiong et al., "Development of tumor targeting anti-MUC-1 multimer: effects of di-scFv unpaired cysteine location on PEGylation and tumor binding," *Protein Eng Des Sei.*, (2006) 19(8):359-67.
Yao, J.C., et al., "One hundred years after carcinoid: epidemiology of and prognostic factors for neuroendocrine tumors in 35,825 cases in the United States," *J Clin Oncol.* (Jun. 20, 2008) 26:3063-72.
Zarebczan, B., Chen H., "Signaling mechanisms in neuroendocrine tumors as targets for therapy," *Endocrinol Metab Clin North Am.* (2010) 39(4):801-10.
Zeng et al., "hOLF44, a secreted glycoprotein with distinct expression pattern, belongs to an uncharacterized olfactomedin-like subfamily newly identified by phylogenetic analysis." *FEBS Letters.* (2004) 571:74-80.
Zheng et al., "Administration of noncytolytic IL-10/Fc in murine models of lipopolysaccharide-induced septic shock and allogeneic islet transplantation," *J Immunol.* (1995) 154(10):5590-600.
Zhou, Bin-Bing S., et al., "Tumour-initiating cells: challenges and opportunities for anticancer drug discovery," *Nat Rev Drug Disco.* (Oct. 2009) 8(10):806-23.
Zimmerman et al., "A triglycine linker improves tumor uptake and biodistributions of 67-Cu-labeled anti-neuroblastoma MAb chCE7 F(ab')2 fragments," *Nucl Med Biol.* (1999) 26(8):943-50.
International Search Report and Written Opinon of the International Searching Authority dated Jan. 31, 2014, in PCT/US2013/027391.
IPRP dated Aug. 5, 2014, in PCT/US2013/027391.
International Search Report and Written Opinon of the International Searching Authority dated Aug. 11, 2014, in PCT/US2014/017810.
IPRP dated Aug. 25, 2015, in PCT/US2014/017810.
International Search Report dated Apr. 4, 2014, issued in PCT/GB2014/050407.
International Search Report and Written Opinion of the International Searching Authority dated Dec. 24, 2014, in PCT/US2014/053304.
IPRP dated Mar. 1, 2016, in PCT/US2014/053304.
International Search Report and Written Opinion of the International Searching Authority dated Jun. 8, 2015, in PCT/US2015/017171.
IPRP dated Aug. 23, 2016, in PCT/US2015/017171.
Gunnersen et al., "Seizure-Related Gene 6 (Sez-6) in Amacrine Cells of the Rodent Retina and the Consequence of Gene Deletion," PLoS One, Aug. 2009, 4(8):1-10 XP-002694859.
Gunnersen et al., "Sez-6 Proteins Affect Dendritic Arborization Patterns and Excitability of Cortical Pyramidal Neurons," Neuron, Nov. 21, 2007, 56(4):621-639 PMID: 18031681.
Mullendore et al., "Ligand-dependent Notch signaling is involved in tumor initiation and tumor maintenance in pancreatic cancer," Clin Cancer Res., Apr. 1, 2009, 15(7):2291-2301. doi: 10.1158/1078-0432.CCR-08-2004. Epub Mar. 3, 2009.
Umetsu et al., Seibutsu Butsuri, 2004, 44(3):102-107.
Yarilin, A. A., "Immunology basics", M.: Medicine, 1999, pp. 169-179.
Official action dated Sep. 19, 2018, issued in Colombian application (No. NC2016/0001859).
Official action dated Jun. 27, 2018, issued in Eurasian application (No. 201691683).
Official action dated Nov. 19, 2018, issued in European application (No. 15752054.5).
Official action dated May 14, 2018, issued in Panamanian application (No. 91316).

Binding Characteristics of Anti-DLL3 Antibodies

| Clone | Bin | Domain | Affinity (nM) |
|---|---|---|---|
| SC16.4 | F | EGF4 | 0.5$^F$ |
| SC16.8 | A | EGF5 | 0.5$^F$ |
| SC16.10 | E | EGF2 | 4.0$^F$ |
| SC16.13 | B | EGF2 | 2.0$^B$ |
| SC16.15 | G | N-terminal | 0.5$^B$ |
| SC16.25 | C | N-terminal | 0.2$^B$ |
| SC16.34 | D | DSL | 0.2$^B$ |
| SC16.39 | I | EGF6 | 1.0$^F$ |
| SC16.46 | A | EGF1 | 0.5$^F$ |
| SC16.51 | H | N-terminal | 2.0$^F$ |
| SC16.56 | D | DSL | 1.0$^B$ |
| SC16.65 | B | EGF2 | 0.9$^B$ |
| SC16.67 | D | EGF3 | 0.5$^F$ |

$^B$ Biacore; $^F$ ForteBio

FIG. 5

Amino Acid Sequences of Exemplary Murine Anti-DLL3 Antibody Light Chain Variable Regions

| mAb | FR1 | CDR1 | FR2 | CDR2 | FR3 | CDR3 | FR4 | SEQ ID NO. |
|---|---|---|---|---|---|---|---|---|
| SC16.3 | QIVLTQSPAIMSVSLGERVTMTC | TASSSVSSSYLH | WYQQKPGSSPKLWIY | STSNLAS | GVPARFSGSGSGTSYFFTISSMEAEDAATYYC | HQYHRSPFT | FGAGTKLKIR | 21 |
| SC16.4 | DIQMTQTSSSLSASLGDRVTISC | RASQDISNYLN | WYQQKPDGTVKLLIY | YTSRLHS | GVPSRFSGSGSGTDYSLTISNLELEDIATYFC | QQGDMLPWT | FGGGTKLEIK | 25 |
| SC16.5 | QIVLTQSPAIMSASPGEKVTMTC | SASSSVSYMH | WYQQKSGTSPKRWIY | DTSKLAS | GVPARFSGSGSGTSYSLTISSMEAEDAATYYC | CQWTRNPLT | FGAGTKLELK | 29 |
| SC16.7 | NIMMTQSPSSLAVSAGEKVTMSC | KSSQSVLYSSNQKNYLA | WYQQKPGQSPKLLIY | WASTRES | GVPDRFTGSGSGTDFTLTISTVGVEDLAVYYC | HQYLSSWT | FGGGTKLEIK | 33 |
| SC16.8 | EIQMTQSPSSMSASLGDRITTC | QATQDIVKNLN | WYQQKPGKPPSFLIY | YAIELAE | GVPSRFSGSGSGSDYSLTISNLESEDFADYYC | LQFYEFPFT | FGAGTKLEIK | 37 |
| SC16.10 | QIVLTQSPAIMSASLGERVTMTC | TASSSVSSSYLH | WYQQKPGSSPKLWIY | STSNLAS | GVPTRFSGSGSGTSYSLTISSMEAEDAATYYC | HQYHRSPFT | FGSGTKLEIK | 41 |
| SC16.11 | DVEMTQTPLTLSVTIGQPASISC | KSSQSLSDSDGKTYLN | WMFQRPGRSPKRLIY | LVSKLDS | GVPDRFTGSGSGTDFTLKISRVEAEDLGVYYC | WQGKHFPWT | FGGGTKLEIK | 45 |
| SC16.13 | QIVLTQSPALVSASPGEKVTMTC | SASSSVSYMY | WYQQKPRSSPKPWIY | LTSNLAS | GVPARFSGSGSGTSYSLTISSMEAEDAATYYC | QQWRSNPFT | FGSGTKLEIK | 49 |
| SC16.15 | DIQMTQSPASLAASVGETVAITC | RASENIYYNLA | WYQQKQGKSPQLLIY | TANSLED | GVPSRFSGSGSGTQYSLKINSMQPEDSATYFC | KQAYDVPPT | FGGGTKLEIK | 53 |
| SC16.18 | DIQMTQTSSSLSASLGDRVTSC | RASQNININYLN | WYQQKPDGTVKLLIY | YTSRLHS | GVPSRFSGSGSGTDYSLTISNLEPEDIATYYC | QQYSERPYT | FGGGTKLEIK | 57 |
| SC16.19 | DIQMTQSPSSLSASLGGGKVTFTC | KASQDIHKYVA | WYQHKPGKGPRLLIH | YTSTLQP | GISSRFSGSGSGRDYSFSISNLEPEDIATYYC | LQYNNLYT | FGGGTKLEIK | 61 |
| SC16.20 | EIQMTQSPSSMSASLGDRITTC | QATQDIVKNLN | WYQQKPCKPPSFLIY | YATELAE | GVPSRFSGSGSGSDYSLTIRNLESEDFADHYC | LQFYEFPFT | FGAGTKLEIK | 65 |
| SC16.21 | DMVMTQSPSSLAMSVGQKVTMSC | KSSQSLLNESSNQKNYLA | WYQQEPGQSPKLLVS | FASTRES | GVPDRFTGSGSGTDFTLTISGVQAEDLAVYYC | QQHYSIPLT | FGACTKLELK | 69 |
| SC16.22 | DIQMTQTSSSLSASLGDRVTSC | RASQDIKNYLN | WYQQKPDGTVKPLIY | YTSRVHS | GVPSRFSGSGSGTDYSLTISNLEQEDIATYFC | QQGYTLPFT | FGSGTKLEIK | 73 |
| SC16.23 | QIVLTQSPAIMSASPGEKVTLTC | SASSSVSRYLY | WYQQKPGSSPKLWIY | STSNLAS | GVPARFSGSGSGTSYSLIISSMEAEDAASYFC | HQWSNYPLT | FGAGTKLEIK | 77 |
| SC16.25 | QIVLTQSPAIMSASPGEKVTMTC | SASSSVSYMH | WYQQKSGTSPKRWIY | DSSKLAS | GVPARFSGSGSGTSYSLTISSMEAEDAATYYC | QQWSSNPLT | FGAGTKLELK | 81 |
| SC16.26 | DVEMTQTPLTLSVTIGQPASISC | KSSQSLSDSDGKTYLN | WMFQRPGRSPKRLIY | LVSKLDS | GVPDRFTGSGSGTDFTLKISRVEAEDLGVYYC | WQGKHFPWT | FGGGTKLEIK | 85 |
| SC16.29 | QIVLTQSPAIMSASPGEKVTITC | SASSSVSYMH | WFQQKPGTSPKLWIY | TTSNLAS | GVPARFSGSGSGTSYSLTVSRMEAEDAATYYC | QQRSLYPYT | FGGGTKVEIK | 89 |
| SC16.30 | QIVLTQSPTIMSASLGERVTMTC | TASSSVTSSYLH | WYQQKPGSSPKLWIY | STSNLAS | GVPARFSGSGSGTSYSLTISSMEAEDAATYYC | HQFHRSPFT | FGSGTKLEIK | 93 |
| SC16.31 | DIVLTQSPSLSLPVNIGDQASISC | KSTKSLLNSDGFTYLD | WYLQRPGQSPQFLIY | LVSNRFS | GVPDRFSGSGSGTDFTLKISRVEAEDLGVYYC | FQSNYLPLT | FGAGTKLEIR | 97 |

FIG. 6A

Amino Acid Sequences of Exemplary Murine Anti-DLL3 Antibody Light Chain Variable Regions

| mAb | FR1 | CDR1 | FR2 | CDR2 | FR3 | CDR3 | FR4 | SEQ ID NO. |
|---|---|---|---|---|---|---|---|---|
| SC16.34 | SIVMTQTPKFLLVSAGDRVTITC | KASGSVSNDVA | WYQQKPGQSPKLLIY | YASNRYS | GVPDRFTGSGYGTDFTFTISTVQAEDLAVYFC | QQDYSSPWT | FGGGTKLEIK | 101 |
| SC16.35 | DIQMTQTTSSLSASLGDRVTISC | RASQDISNYLN | WYQQKPDGTVKLLIY | YTSRLHS | GVPSRFSGSGSGTDYSLTISNLEGEDIATYFC | QQGNTLPYT | FGGGTKLEIK | 105 |
| SC16.36 | ETTVTQSPASLSVTTGEKVTIRC | ITTPDIDDDMN | WYQQKPGEPPNLLIS | EGNSLRP | GVPSRFSSSGYGTNFVFTIENTLSEDVADYYC | LQSDNMPFT | FSSGTKLEIK | 109 |
| SC16.38 | QIVLTQSPAIMSASPGEKVTMTC | SASSSINYMH | WYQQKPGTSPKRWIY | DTSKLAS | GVPARFSGSGSGTSYSLTISSMEAEDAATYYC | HQRSTWT | FGGGTKLEIK | 113 |
| SC16.41 | DIQMTQTTSSLSASLGDRVTISC | RASQDVINYLN | WYQQKPDGTVKLLIY | YTSRLHS | GVPSRFSGSGSGRTDYSLTISNLEPEDIATYYC | QQYSERPYT | FGGGTKLEIK | 117 |
| SC16.42 | DVLMTQSPLSLSVSLGDQASISC | RSSQNIVHSDRYTYLE | WYLQKPGQSPKLLIY | GVSNRFS | GVPDRFSGSGSGTDFTLKISRVEAEDMGVYYC | FQGTHVPYT | FGGGTKLEIK | 121 |
| SC16.45 | EIQMTQSPSSMSASLGDRIITC | GATQDIVKNLN | WYQQKPGKPPSFLIY | YATELAE | GVPARFSGSGSGSDYSLTISNLESEDFADYHC | LQFYEPPFT | FGAGTKLELK | 125 |
| SC16.47 | DVVLTQSPLSLPVNIGDQASISC | KSTKSLLNSDGFTYLD | WYLQRPGQSPQCFLIY | LVSNRFS | GVPDRFSGSGSGTDFTLKISRVEAEDLGVYYC | FQSNYLPLT | FGAGTKLELR | 129 |
| SC16.49 | DIKMTQSPSSMYASLGERVTITC | KASQDINSYLS | WFQQKPGKSPKTLY | RANRLVD | GVPSRFSGSGSGQDYSLTITSLEYEDMGNYC | LQYDEFPLT | FGAGTKLELK | 133 |
| SC16.50 | DIQMTQTTSSLSASLGDRVTISC | RASQDISNYLN | WYQQKPDGTVKLLIY | YTSRLHS | GYPSRFSGSGSGTDYSLTISNLEGEDIATYYC | QQGNTLRT | FGGGTKLEIK | 137 |
| SC16.52 | DIQMQSPSSMFASLGDRVSLSC | RASQGIRGTLD | WYQQKPNGTIKLLIY | STSNLNS | GVPSRFSGSGSGSDYSLTSSLESEDFADYYC | LQRNAYPLT | FGAGTKLELK | 141 |
| SC16.55 | DIKMTQSPSSMYASLGERVTITC | KASQDINSYLN | WFQQKPGKSPKTLY | RANRLVD | GVPSRFSGSGSGQDYSLTISSLEYEDMGNYC | LQYDEFPYT | FGGGTKLELK | 145 |
| SC16.56 | SIVMTQTPKFLLVSAGDRVTITC | KASGSVSNDVY | WYQQKPGQSPKLLIY | YASNRYT | GVPDRFAGSGYGTDFSFTISTVQAEDLAVYFC | QQDYTSPWT | FGGGTKLEIR | 149 |
| SC16.57 | DIVMTQSHKFMSISVGDRYSITC | KASQDVSIFVA | WYQQKPGQSPKLLIY | SASYRYT | GVPDRFTGSGSGTDHFTISSVQAEDLAVYYC | QQHYGTPFT | FSSGTKLKIR | 153 |
| SC16.58 | DIQMTQSPASLSSSVGETVTITC | RASENIYSYLA | WYQQKQGKSPQLLVY | NAKTLAE | GVPSRFSGSGSGTQFSLKINSLQPEDFGTYYC | QHHYDSPLT | FGAGTKLELR | 157 |
| SC16.61 | DIVMTQSTSSLAMSVGQKVTMSC | KSSQSLLNSSNQKNYLA | WYQQEPGQSPKLLVS | FASTRES | GVPDRFTGSGSGTDFTLTISGVQAEDLAVYYC | QQHYSPLT | FGAGTKLELK | 161 |
| SC16.62 | DIKMTQSPSSMYASLGERVTITC | KASQDINSFLS | WFQRKPGKSPKTLY | RANRLVD | GVPSRFTGSGSGQEFSLTISSLEYEDLGNYYC | LQYDEFPYT | FGGGTKLEIK | 165 |
| SC16.63 | QIVLTQSPAIMSASPGEKVTMTC | SASSSVSMY | WYQQKSGTSPKRWIY | DTSKLAS | GVPARFSGSGSGTSYSLTISSMEAEDAATYYC | QQWSSNPYT | FGGGTKLEIK | 169 |
| SC16.65 | QIVLTQSPALMSASPGEKVTMTC | SVTSSVSYMY | WYQQKPRSSPKPWIY | LTSNLAS | GVPARFSGSGSGTSYSLTISSVEAEDAATYYC | QQWRNNPFT | FSSGTKVEIK | 173 |
| SC16.67 | QAVVTQESALLTSPGETVLTC | RSSTGAVTTSNYAN | WIQEKPDHLFTGLIG | GTNNRAP | GVPARFSGSLLGDKAALTITGAQTEDEAYFC | GLWYSNHLV | FGGGTKLTVL | 177 |
| SC16.68 | ETTVTQSPAFLSVATGEKVTIRC | ITSTDIDDDMN | WYQQKPGEPPNVLIS | EGNTLRP | GVPSRFSSSGYGTDFVFTIENTLSEDVADYYC | LQSDNMPLT | FGAGTKLELK | 181 |
| SC16.72 | ENVLTQSPAIMSASLGEKVTMSC | RASSSVNYMS | WYQQKSDASPKLWIY | YTSNLAP | GVPARFSGSGSGNSYSLTISSMEGEDAATYYC | QQFTSSPYT | FGGGTKLEIK | 185 |

FIG. 6A cont.

Amino Acid Sequences of Exemplary Murine Anti-DLL3 Antibody Light Chain Variable Regions

| mAb | FR1 | CDR1 | FR2 | CDR2 | FR3 | CDR3 | FR4 | SEQ ID NO. |
|---|---|---|---|---|---|---|---|---|
| SC16.73 | DIQMTQSPSSLSASLGERVSLTC | RASQDIGYSLN | WLQQEPDGTIKRLIY | ATSSLDS | GVPKRFSGSRSGSDYSLTISSLESEDFVDYC | LQYASSPWT | FGGGTKLEIK | 189 |
| SC16.78 | DIKMTQSPSSMYASLGERVTITC | KASQDINSYLS | WFQQKPGRSPKTLIY | RANRLVD | GVPSRFSGSGSGQDYSLTISSLDYEDMGIYYC | LQYDEFPFT | FGSGTKL<u>EIK</u> | 193 |
| SC16.79 | DIVMSQSPSSLAVSAGEKVTMSC | KSSQSLLNSRTRKNYLA | WYQQKPGQSPKLLIY | WASTRES | GVPDRFTGSGSGTDFTLTISSVQAEDLAVYYC | KQSYNLYT | FGGGTKLKIK | 197 |
| SC16.80 | ETTVTQSPASLSMAIGEKVTIRC | ITSTDIDDDMI | WYQQKPGEPPKLLIS | EGNTLRP | GVPSRFSSSGYGTDFVFTIENMLSEDVADYYC | LKRDDLPYT | FGGGTQVEIK | 201 |
| SC16.81 | QIVLTQSPAIMSASLGERVTLTC | TASSSVSSSYLH | WYQQKPGSSPKLWIY | STSNLAS | GVPTRFSGSGSGTSYSLRISSMEAEDAATYYC | HQYNRSPLT | FGAGTKLEIK | 205 |
| SC16.84 | DIQMTQSPSSLSASLGGKVTITC | KASQDIKKYIA | WYQHKPGKGPRLLIH | YTSTLEP | GIPSRFSGSGSGRDYSFSISNLEPEDIATYYC | LQYDILWT | FGGGTKLEIK | 209 |
| SC16.88 | ENVLTQSPAIMAASLGQKVTMTC | SASSSVSSSYLH | WYQQKSGASPKPLIH | RTSNLAS | GVPARFSGSGSGTSYSLTISSVEAEDDAITYYC | RQWSGYPWT | FGGGTKLEIK | 213 |
| SC16.101 | QIVLTQSPAIMSASLGERVTMTC | TASSSVSSSYLH | WYQQKPGSSPKLWIY | STSNLAS | GVPARFSGSESGTSYSLTISNMEAEDAATYYC | HQYHRSPFT | FGSGTKLEIK | 217 |
| SC16.103 | DIVLTQSPASLAVSLGQRATISC | RASKSVSTSGYSYMH | WYQQKPGQPPKLLIY | LASNLES | GVPARFSGSGSGTDFTLNIHPVEEEDAATYYC | QHSRELPLT | FGAGTKLELK | 221 |
| SC16.104 | QIVLSQSPAILSASPGEKVTMTC | RASSSVSYIH | WYRQKGSSPKPWIY | ATSNLAS | GVPARFSGSGSGTSYSLTISRVEAEDAATYYC | QQWSSNPPT | FGAGTKLELK | 225 |
| SC16.105 | DIVMTQSHKFKFMSTSVGDRVSITC | KASQDVGTAVA | WYQQKPGQSPKLLIY | WASIRHT | GVPDRFTGSGSGTDFTLTISNVQSEDLADYFC | QQYSSYPLT | FGAGTKLELK | 229 |
| SC16.106 | DIKMTQSPSSMYASLGERVTITC | KASQDINSYLS | WFQQKPGKSPKTLIY | RANRLVD | GVPSRFSGSGSGQDYSLTISSLEYEDMGIYYC | LQYDEFPFT | FGSGTKLEIK | 233 |
| SC16.107 | DIVMTQSHKFKFMSTSVGDRVSITC | KASQDVNTAVG | WYQQKPGQSPKLLIY | SASYRYT | GVPDRFTGSGSGTDFTFTISSVQAEDLAVYYC | QCHYSSPYT | FGGGTKVEIK | 237 |
| SC16.108 | DIQMTQSPASLSASVGETVTITC | RASENIYSYLA | WYQQKQGKSPQLLVY | NAKTLAE | GVPSRFSCSRSGSQFSLKINSLQPEDFGSYYC | QHHYGTPYT | FGGGTKLEIK | 241 |
| SC16.109 | QIVLTQSPAIMSASPGEKVTMTC | SASSSVSYMY | WYQQKPGSSPRLLIY | DTSNLAS | GVPVRFSGSGSGTSFSLTISRMEAEDTATYYC | QEWSGNPLT | FGDGTKLELK | 245 |
| SC16.110 | NIVMTQTPKFLLVSAGDRVTITC | KASQSVSNDVA | WYQQKPGQSPKLLIY | YASNRYT | GVPDRFTGSGYGTDFTFTISTVQAEDLAVYFC | QQDYSSPPT | FGGGTKLEIK | 249 |
| SC16.111 | DIQMTQSPASLAASVGETVTITC | RASENIYYSLA | WYQQKQGKSPQLLIY | NANSLED | GVPSRFSGSGSGTQYSMKINSMQPEDTATYFC | KQTYDVPLT | FGAGTKLELK | 253 |
| SC16.113 | DVVMTQTPLTLSVTIGQPASISC | KSSQSLLDSDGTTYLN | WLLQRPGQSPKRLIY | LVSKLDS | GVPDRFTGSGSGTDFTLKISRVEAEDLGVYYC | WQGTHFPLT | FGAGTKLELK | 257 |
| SC16.114 | QIVLSQSPAILSASPGEKVTMTC | RASSSVSYMH | WYQQKPGSSPKPWIY | ATSNLAS | GVPARFSGSGSGTSYSLTISRVEAEDAATYYC | QQWSSNPYT | FGGGTKLEIK | 261 |
| SC16.115 | DVVMTQTPLTLSVTIGQPASISC | KSSQSLLDSDGTTYLN | WLLQRPGQSPKRLIY | LVSKLDS | GVPDRFTGSGSGTDFTLKISRVEAEDLGVYYC | WQGTHFPLT | FGAGTKLELK | 265 |

FIG. 6A cont.

Amino Acid Sequences of Exemplary Murine Anti-DLL3 Antibody Light Chain Variable Regions

| mAb | FR1 | CDR1 | FR2 | CDR2 | FR3 | CDR3 | FR4 | SEQ ID NO. |
|---|---|---|---|---|---|---|---|---|
| SC16.116 | DIVMTQSPSSLTVTAGEKVTMSC | TSSQSLLTSGNQKNYLT | WYQQKPGQPPKLLIY | WASTRES | GVPDRFTGSGSGTDFTLTISSLQAEDLAVYYC | QNDYSLT | FGAGTKLELK | 269 |
| SC16.117 | DIQMNQSPSSLSASLGDTITITC | HVSQNINVWLS | WYQQKPGNIPKLLIQ | KASNLHT | GVPSRFSGSGSGTGFTLTISSLQPEDIATYYC | QQGQSYPFT | FGSGTKLEIK | 273 |
| SC16.118 | DIVLTQSPASLAVSLGQRATISC | KASQSVDYDGDSYLT | WYQQKPGQPPKLLIY | AASNLES | GIPARFSGSGSGTDFTLNIHPVEEEDAATYYC | QQSNEDPYT | FGGGTKLEIK | 277 |
| SC16.120 | DIVMSQSPSSLAVSVGEKVTMSC | KSSQSLLYSSTQKNYLA | WYQQKPGQSPKLLIY | WASTRES | GVPDRFTGSGSGTDFTLTISSVKAEDLAVYYC | QQYYSYPYT | FGGGTKLEIK | 281 |
| SC16.121 | QIVLTQSPAIMSASPGEKVTITC | SASSVSYMH | WFQQKPGTSPKLWIY | STSNLAS | GVPARFSGSGSGTSYSLTISRMEAEDAATYYC | QQRSSYPPT | FGGGTKLEIK | 285 |
| SC16.122 | DIVMTQSQKFMSTSVGDRVSVTC | KASQNVGTNVA | WYQQKPGQSPKVLIY | SASYRYS | GVPDRFTGSGSGTDFTLTISNVQSEDLAEFFC | QQYNSYPLT | FGGTKLEIK | 289 |
| SC16.123 | QIVLTQSPAIMSASLGERVTMTC | TASSSVSSSYLH | WYQQKPGSSPKLWIY | STSNLAS | GVPARFSGSGSGTSYSLTISSMETEDAATYYC | HQYHRSPFT | FGSGTKLEIK | 293 |
| SC16.124 | DIQMTQSPASQSASLGESVTITC | LASQTIGTWLA | WYQQKPGKSPQLLIS | AATSLAD | GVPSRFSGSGSGTKFSFKISSLQAEDFVSYYC | QQLYSTPWT | FGGGTKLEIK | 297 |
| SC16.125 | DIQMNQSPSSLSASLGDTITITC | HASQNINVWLS | WYQQKPGNIPKLLIY | KASILHT | GVPSRFSGSGSGTGFTLTISSLQPEDIATYSC | QQGQSYPYT | FGGGTKLEIK | 301 |
| SC16.126 | DIQMNQSPSSLSASLGDTITITC | HASQNINVWLS | WYQQKPGNIPKLLIY | KASNLHT | GVPSRFSGSGSGTGFTLTISSLQPEDIATYYC | QQGQSYPFT | FGSGTKLEIK | 305 |
| SC16.129 | DIQMTQSPASQSASLGESVTITC | LASQTIGTWLA | WYQQKPGKSPQLLIY | AATSLAD | GVPSRFSGSGSGTKFSFKISSLQAEDFVSYYC | QQLYSTPYT | FGGGTKLEIK | 309 |
| SC16.130 | DIQLTQSPASLSASVGETVTITC | RASGSIHNYLA | WYQQKQGKGKSPQLLVY | NAKTLVD | GVPSRFSGSGSGTQVSLKINSLQPEDFGYYYC | QHFWTTPWT | FGGGTKLEIK | 313 |
| SC16.131 | DIQMNQSPSSLSASLGDTITITC | HVSQNINVWLS | WYQQKPGNIPKLLIQ | KASNLHT | GVPSRFSGSGSGTGFTLTISSLQPEDIATYYC | QQGQSYPFT | FGSGTKLEIK | 317 |
| SC16.132 | DIQMTQSPASQSASLGESVTITC | LASQTIGTWLA | WYQQKPGKSPQLLIY | AATSLAD | GVPSRFSGSGSGTKFSFKISSLQAEDFVSYYC | QQLYSTPWT | FGGGTKLEIK | 321 |
| SC16.133 | SIVMTQTPKFLLVSAGDRVTITC | KASQSVSNDVA | WYQQKPGQSPKLLIY | CASNRYT | GVPDRFTGSGYGTDFTFTISTVQAEDLAVYYC | QQDYSSPLT | FGAGTKLELK | 325 |
| SC16.134 | DIVLTQSPASLAVSLGQRATISC | KASQSVDHAGDSYMN | WYQQKPGQPPKLLIY | AASNLES | GIPARFSGSGSGTDFTLNIHPVEEEDAATYYC | QQSNEDPYT | FGGGTKLEIK | 329 |
| SC16.135 | DIKMTQSPSSMYASLGERVTITC | KASQDINRYLS | WFQQKPGKSPKTIY | RANRLVD | GVPSRFSGSGSGQDYSLTISSLEYEDMGIYYC | LQYDEPPFT | FGSGTKLEIK | 333 |
| SC16.136 | DIQMTQSPASLSASVGFTVTITC | RASGNIHNYLA | WYQQKQGKSPHLLVY | NAKTLAD | GVPSRFSGSGSGTQVSLKINSLQPEDFGSYYC | QHFWSTPWT | FGGGTKLEIK | 337 |
| SC16.137 | QIVLTQSPAIMSASLGEEITLTC | SASSVSYMH | WYQKSGTSPKLLIY | STSNLAS | GVPSRFSGSGSGTFVSLTISSVEAEDAADYYC | HQWSSYHT | FGGGTKLEIK | 341 |

FIG. 6A cont.

Amino Acid Sequences of Exemplary Murine Anti-DLL3 Antibody Light Chain Variable Regions

| mAb | FR1 | CDR1 | FR2 | CDR2 | FR3 | CDR3 | FR4 | SEQ ID NO. |
|---|---|---|---|---|---|---|---|---|
| SC16.138 | DIQMTQSPASQSASLGESVTITC | LASQTIGTWLA | WYQQKPGKGSPQLLIY | SATSLAD | GVPSRFSGSGSGTKFSFKISSLQAEDFVSYYC | QQLYSTPWT | FGGGTKLEIK | 345 |
| SC16.139 | DIVMTQSHKFMSTSVGDRVSITC | KASQDVNTAVG | WYQQKPGQSPKLLIY | SASYRYT | GVPDRFTGSGSGTDFTFTISSVQAEDLAVYYC | QQHYSSPYT | FGGGTKLEIK | 349 |
| SC16.140 | DIVLTQSLASLAVSLGQRATISC | RASKSVSTSGYSYMH | WYQQKPGQPPKLLIY | LASNLES | GVPARFSGSGSGTDFTLNIHPVEDEDAATYYC | QHSRELPFT | FGGGTKLEIK | 353 |
| SC16.141 | DIKMTQSPSSMYASLGERVTITC | KASQDINSYLS | WFQQKPGKSPKTLIY | RANRLVD | GVPSRFSGSGSGQDYSLTISSLEYEDMGIYYC | LQYDEFPFT | FGSGTKLEIK | 357 |
| SC16.142 | DIKMTQSPSSMYASLGERVTITC | KASQDINNYLS | WFQQKPGKSPKTLIY | RANRLVD | GVPSRFSGSGSGQDYSLTISSLEYEDMGIYYC | LQYDEFPYT | FGGGTKLEIK | 361 |
| SC16.143 | DVLMTQTPLSLPVSLGDQASISC | RSSQSIVHSNGNTYLE | WYLQKPGQSPKLLIY | KVSNRFS | GVPDRFSGSGSGTDFTLKISRVEAEDLGVYYC | FQGSHVPLT | FGAGTKLEIK | 365 |
| SC16.144 | SIVMTQTPKFLLVSAGDRVTITC | KASQSVSNDVG | WYQQKPGQSPKLLIY | YASNRYN | GVPDRFTGSGYGTDFTFTISVQAEDLAVYFC | QQDYSSPWT | FGGGTKLEIK | 369 |
| SC16.147 | DIQMTQTASSLSASLGDRVTISC | RASQDINNYLN | WYQQKPDGTVKLLIY | YTSRLHS | GVPSRFSGSGSGTDYSLTISILEQEDIATYFC | QQGDTLPWT | FGGGTKLEIK | 373 |
| SC16.148 | QIVLTQSPAIMSASPGEKVTMTC | SASSSVSYMY | WYQQKPGSSPRLLIY | DTSNLAS | GVPVRFSGSGSGTSYSLTISRMEAEDTATYYC | QEWSNNPLT | FGDGTKLEIK | 377 |
| SC16.149 | DIQMNQSPSSLSASLGDTITITC | HASQNINVWLS | WYQQKPGNIPKLLIY | KASHLHT | GVPSRLSGSGSGTGFTLTISSLQPEDIATYYC | QQGQSYPFT | FGSGTTLEIK | 381 |
| SC16.150 | DIVMSQSPSSLTVSVGEKVTMSC | MSSQSLLYSSTQKNYLA | WYQQKPGQSPKLLIY | WASTRES | GVPDRFTGSGSGTDFTLTISSVKAEDLAVYYC | QQIYSYPYT | FGGGTKLEIK | 385 |

FIG. 6A cont.

Amino Acid Sequences of Exemplary Humanized Anti-DLL3 Antibody Light Chain Variable Regions

| mAb | FR1 | CDR1 | FR2 | CDR2 | FR3 | CDR3 | FR4 | SEQ ID NO. |
|---|---|---|---|---|---|---|---|---|
| hSC16.13 | DIQMTQSPSSLSASVGDRVTITC | SASSSVSYMY | WYQQKPGKAPKLLIY | LTSNLAS | GVPSRFSGSGSGTDFTLTISSLQPEDFATYYC | QQWRSNPFT | FGQGTKLEIK | 389 |
| hSC16.15 | AIQLTQSPSSLSASVGDRVTITC | RASENIYYNLA | WYQQKPGKAPKLLIY | TANSLED | GVPSRFSGSGSGTDFTLTISSLQPEDFATYFC | KQAYDVPPT | FGGGTKLEIK | 393 |
| hSC16.25 | EIVLTQSPDFQSVTPKEKVTITC | SASSSVSYMH | WYQQKPDQSPKLLIK | DSSKLAS | GVPSRFSGSGSGTDFTLTINSLEADAATYYC | QQWSSNPLT | FGQGTKLEIK | 397 |
| hSC16.34 | DIQMTQSPSSLSASVGDRVTITC | KASQSVSNDVA | WYQQKPGKVPKLLIY | YASNRYS | GVPSRFSGSGSGTDFTLTISSLQPEDVATYFC | QQDYSSPWT | FGGGTKVEIK | 401 |
| hSC16.56 | EMMTQSPATLSVSPGERATLSC | KASQSVSNDVV | WYQQKPGQAPRLLIY | YASNRYT | GIPARFSGSGSGTEFTLTISSLQSEDFAVYYC | QQDYTSPWT | FGQGTKLEIK | 405 |

FIG. 6A cont.

Amino Acid Sequences of Exemplary Murine Anti-DLL3 Antibody Heavy Chain Variable Regions

| mAb | FR1 | CDR1 | FR2 | CDR2 | FR3 | CDR3 | FR4 | SEQ ID NO. |
|---|---|---|---|---|---|---|---|---|
| SC16.3 | QVTLKESGPGILQPSQTLSLTCSFSGFSLS | TSGMGVG | WIRQPSGKGLEWLA | HIWWDDVKRYNPALKS | RLTISKDTSSSQVFLKIASVDTADTATYYCAR | IADYGGDYYAMDY | WGQGTSVTVSS | 23 |
| SC16.4 | QIQLVQSGPELKKPGETVKISCKASGYTFT | DYSMH | WVKQAPGKGLKVWMG | WINTETGEPGYADDFKG | RFAFSLETSASTAYLQINNLKNEDTATYFCAR | YDGYAMDY | WGQGTSVTVSS | 27 |
| SC16.5 | QVTLKESGPGILQPSQTLSLTCSFSGFSLS | TSGMGVG | WIRQPSGEGLEWLA | DIWWDDNKYYNPSLKS | RLTISKDTSSNQVFLKITSVDTADTATYYCAR | RVNVYYDPYYAMDY | WGQGTSVTVSS | 31 |
| SC16.7 | EVQLQQSGPELVKPGASVKISCKASGYSFT | GYKMH | WVKQSHVKSLEWIG | RINPYNGATSYNQNFKD | KATLTVDKSSSTAYMDLHSLTSEDSAVYFCAR | GDYRYDWFAY | WGQGTLVTVSA | 35 |
| SC16.8 | QAQLQQSGAELVRPGTSVKVSCKASGYAFT | NYLIE | WVKQRPGQGLEWIG | VINPGTGTNYNENFKG | KATLTADKSSSTAYMQLSSLTSDDSAVYFCAR | SPYDYHEGAMDY | WGQGSVTVSS | 39 |
| SC16.10 | QVTLKESGPGILQSSQTLSLTCSFSGFSLS | TSGMGVG | WIRQPSGKGLEWLA | VINPGTGTNYNPVLKS | RLTISKDTSSSQVFLKIASVDTADTATYYCAR | LVDDLYYFDY | WGQGTTLTVSS | 43 |
| SC16.11 | QIQLVQSGPELKKPGETVKISCKASGYTFT | DYSMH | WVKQAPGKGLKVWMG | WINTEVEPTYADDFMG | RFAFSLETSASTAFLQINNLENEDTATYFCAR | FGSYAMDY | WGQGTSVTVSS | 47 |
| SC16.13 | QVTLKESGPGILQPSQTLSLTCSFSGFSLS | TSGMGVG | WIRQPSGKGLEWLA | HIWWDDVKRYNPALKS | RLTISKDTSSSQVFLKIASVDTADTATYYCAR | IVSFDNDVVSAMDY | WGQGTSVTVSS | 51 |
| SC16.15 | QVQLQQSGAELAKPGASVKMSCKASGYTFT | RYWIH | WIKQRPGQGLEWIG | YINPTTVYTEFNQNFKD | KATLTADKSSTTASMQLSSLTSEDSAVYYCAR | GGSNFFDY | WGQGTTLTVSS | 55 |
| SC16.18 | EVKLEESGGGLVQPGESMKLSCAASGFTFS | DAWMD | WVRQSPEKGLEWVA | EIRNKANNHATYYAESVKG | KFTISRDDSKSRVYLQMNNLRAADTGIYYCTA | YSNFAY | WGQGTLVTVST | 59 |
| SC16.19 | EVQLQQSGAELVRPGASVKLSCTASGFNIK | DSLLH | WVKQRPEKGLEWIG | WIDPEDGETKYAPNFQD | KATITTDSSSNTAYLQLISLTSVDTAIYYCAY | GNYVRHFDY | WGQGTTLTVSS | 63 |
| SC16.20 | QVQLQQSGTELVRPGTSVRVSCKASGYAFG | NHLIE | WVKQRPGQGLEWIG | VINPGTGGTHYNEKFKD | KARLTADKSSNTAYMHLNSLTSDDSAVYFCAR | SPYDYHEGAMDY | WGQGTSVTVSS | 67 |
| SC16.21 | QVQLQQSGPELVKPGASVKISCKASGYAFS | SSWMN | WVKQRPGKGLEWIG | RIYPGDGDTNYNGKFKG | KATLTADKSSSTAYMQLSSLTSEDSAVYFCAM | GIYNYDGSRYYSMDY | WGQGTSVTVSS | 71 |
| SC16.22 | QVQLQQSGAELVKPGASVKLSCKASGYTFT | TYWMH | WVKQRPGQGLEWIG | EIDPSDSYTYYNQKFKG | KATLTVDKSSSTAYMQLSSLTSEDSAVYYCAR | GDYGNPYAMDY | WGQGSSVTVSS | 75 |
| SC16.23 | QVTLKESGPGILQPSQTLSLTCSFSGFSLS | TSNTGIG | WIRQPSGTGLEWLA | HIWWNDDKYYNPSLKS | RLTISKETSNNQVFLKITNVDTADTASYFCVQ | IGRDYSNYAWYFDV | WGAGTTVTVSS | 79 |
| SC16.25 | QVTLKESGPGILQPSQTLSLTCSFSGFSLS | TSGMGVG | WIRQPSGEGLEWLT | DIWWNDDKYYNPSLKS | RLTISKDTSNQVFLNITSVDTADTATYYCAR | RVNYYDPYYAMDY | WGQGTSVTVSS | 83 |
| SC16.26 | QIQLVQSGPELKKPGETVKISCKASGYTFT | DYSMH | WVKQAPGKGLKVWMG | WINTEVEPTYADDFMG | RFAFSLETSASTAFLQINNLENEDTATYFCAR | FGSYAMDY | WGQGT<u>VTVSS</u> | 87 |
| SC16.29 | QVQLQQSGAELARPGASVKLSCKASGYTFT | DQYIN | WVKQRTGQGLEWIG | EYPGRGNTYYNEKFKG | KATLTADKSSSTAYMQLSSLTSEDSAVYFCAR | EDGYDDAWFAY | WGQGTLVTVSA | 91 |
| SC16.30 | QVTLKESGPGILQPSQTLSLTCSFSGFSLS | TSGMGVG | WIRQPSGKGLEWLA | HIWWDDVKRYKPALKS | RLTVSKDTSSNQVFLKIATVDAADTGTYYCAR | IMDSHPPFAY | WGQGTLVTVSA | 95 |
| SC16.31 | EVQLQQSGPELVKPGASVKISCKASGYSFS | RFYMH | WVKQSPENSLEWIG | EINPSTGGTSYNQKFKG | KATLTVDKSSSTAYMQLKSLTSEESAVYYCTR | GYGSNWYFDV | WGAGTTVTVST | 99 |

FIG. 6B

Amino Acid Sequences of Exemplary Murine Anti-DLL3 Antibody Heavy Chain Variable Regions

| mAb | FR1 | CDR1 | FR2 | CDR2 | FR3 | CDR3 | FR4 | SEQ ID NO. |
|---|---|---|---|---|---|---|---|---|
| SC16.34 | QIQLVQSGPELKKPGETVKISCKASGYTFT | NYGMN | WVKQAPGKGLKWMG | WINTYTGDPTYADDFKG | RFAFSLETSASTAYLQINNLKNEDTATYFCAR | IGGNSPSDY | WGQGTSLTVSS | 103 |
| SC16.35 | DVQLQESGPGLVKPSQSLSLTCTVTGYSIT | SDYAWN | WIRQFPGNKLEWMG | YISYSGSTSYNPSLKS | RISITRDTSKNQFFLQLNSVTTEDTATYYCAR | FYYGSSYAMDY | WGQGTSVTVSS | 107 |
| SC16.36 | QVQLQQSGAELAKPGASVKMSCKASGYTFT | TYWMH | WVKQRPGQGLEWIG | YINPSSGYTEYNQKFKD | KATLTADKSSSTAYMQLSSLTSEDSSVYYCAR | KGSNRGFAY | WGQGTLVTVSS | 111 |
| SC16.38 | EVQLQQSGAELVKPGASVKLSCTVSGFNIK | DTYIH | WVKQRPEQGLEWIG | RIDPANGNTKYDPKFQG | KATITADTSSNTAYLQLSSLTSEDTAVYYCAR | PTGYFEY | WGQGTLVTVSS | 115 |
| SC16.41 | EVKLEESGGGLVQFGGSMKLSCAASGFTFS | DAWMD | WVRQSPEKGLEWVA | EIRNKANNHATYYPESVKG | RFTISRDDSKSRVYLQMNNLRAEDTGIYYCTG | YSSFAY | WGQGTLVTVSS | 119 |
| SC16.42 | QIQLVQSGPELKKPGETVKISCKASGYTFT | TAGMQ | WVQKMPGKGFKWIG | WINTHSGEPKYADDFKG | RFAFSLETSASTAYLQISNLKDEDTATFFCAP | LWSDSSFAY | WGQGTLVTVSA | 123 |
| SC16.45 | QVQLQQSGADLVRPGTSVKVSCKASGYSFT | NYLIE | WVKQRPGQGLEWIG | VINPSSGGTHYNEKFKD | KAVLTADKSSTTAHMQLSSLTSDDSAVYFCAR | SPYDYNDGAMDY | WGQGTSVTVSS | 127 |
| SC16.47 | EVQLQQSGPELVKPGASVKISCKASGYSFS | RFYMH | WVKGSPENSLEWIG | EINPSTGGTSYNQKFKG | KATLTVDKSSSTAYMQLSLTSEESAVYYCTR | GYGSNCYFDV | WGAGTTVTVST | 131 |
| SC16.49 | QVQLQQSGPELVKPGTLVKISCKASGYTFT | SYDIN | WVKQRPGQGLEWIG | WIYPGDGNTKYSEKFKG | KATILTADKSSSTAYMQLTSLTSENSAVYFCAR | DYDYPFAY | WGQGTLVTVSA | 135 |
| SC16.50 | EVQLVECGGGLVKPGGYLKLSCAASGFTFS | SYAMS | WVRQSPEKRLEWVA | EISIGGSYTYYPDTVTG | RFTISRDNAKNTLYLEMSSLRSEDTAMYYCAR | EGYDYDVRAMDY | WGQGTSVTVSS | 139 |
| SC16.52 | QVQLKESGPGLVAPSQSLSITCAVSGFSLT | SFAIH | WFFKPGKGLEWLG | VIWTGGTTNYNSALMS | RLSISKDNSKSQVFLKMNSLQTDDTAMYYCAR | DDYDNNYAMDY | WGQGTSVTVSS | 143 |
| SC16.55 | EVQLVESGGGLVQPKGSLKLSCAVSAFTFT | TYAMN | WVRQAPGKGLEWVA | RIRNKSNNYATYYADSVKD | RFTISRDDSQSMLYLQMNNLKIEDTAMYYCVF | YYDYVY | WGQGTLVTVSA | 147 |
| SC16.56 | QIQLVQSGPELKKPGETVKISCKASGYTFT | NYGMN | WVKQAPGKGLKWMA | WINTYTGEPTYADDFKG | RFAFSLETSASTASLQINLKNEDTATYFCAR | IGDSSPSDY | WGQGTLTVSS | 151 |
| SC16.57 | EVKLVESGGDLVKPGGSLKLSCAASGFAFS | SYDMS | WVRQTPEKRLEWVA | TISSGGSYTYYPDSVKG | RFTISRDNVRDTLYLQMSSLRSEDTALYYCAR | QAIGTYFDY | WGQGTTLTVSS | 155 |
| SC16.58 | DVQLVESGGGLVQPGGSRKLSCAASGFTFS | SFGMH | WVRQAPEKGLEWVA | YISSGSSNIYYADTVKG | RFTISRDNPKNTLFLQMTSLRSEDTAMYYCAR | GYYGNYDAMDY | WGQGTSVTVSS | 159 |
| SC16.61 | EVLLQRSGPDLVKPGASVTIPCKASGYTFT | DYNMD | WVVKGHSKSLEWIG | NINTYNGGTIYNCKFKG | KATLTVDKPSSTAYMELRSLTSEDTAVYYCAR | RLRYGGHYFDY | WGQGTALTVSS | 163 |
| SC16.62 | EVMILVESGGDLVKPGGSLKLSCAASGFTFS | SYAMS | WVRQTPEKRLEWVA | YISGGGDHHYPDSVRG | RFTISRDNAKDTLYLQMSSLRSEDTALYDCAR | VRDWYFDV | WGAGTTVTVSS | 167 |
| SC16.63 | QVQLQQSGTELLRFPGASVKSCKATGYTFS | SYWME | WVKQRPGHGLEWIG | EILPGSGTTQYNEKFKG | KATFTADTSSNTAYMHLSSLTSEDSAVYYCAR | GTINSL | WGQGTLVTVSA | 171 |
| SC16.65 | QVTLKESGPGILQPSQTLSLTCSFSGFSLS | TSGMGVG | WIRQPSGKGLEWLA | LMWWDDVKRYNPALKS | RLTISKDASSSQVFLKIASVDTADTATYYCAR | IASYDYDVVYAMDY | WGQGTSVSVSS | 175 |
| SC16.67 | EVQLVETGGGLVQPKGSLKLSCAVSAFTFT | TYAMN | WVRQAPGKGLEWVA | RIRNKSNNYATYYADSVKD | RFTISRDDSQSMLYLQMNNLKIEDTAMYYCVF | YYDYVY | WGQGTLVTVSA | 179 |

FIG. 6B cont.

Amino Acid Sequences of Exemplary Murine Anti-DLL3 Antibody Heavy Chain Variable Regions

| mAb | FR1 | CDR1 | FR2 | CDR2 | FR3 | CDR3 | FR4 | SEQ ID NO. |
|---|---|---|---|---|---|---|---|---|
| SC16.68 | QVQLQQPGAELVKPGASVKMSCKASGYTFT | NYNMH | WVKQTPGQGLEWIG | AIFPGNGGTSYNQKFKG | KATLTADKSSSTAYMQLTSLTSGDSAVYYCAR | WGYGSGLYAMDY | WGQGTSVTVSS | 183 |
| SC16.72 | EVQLQQSGPELVKPGASVKMSCKASGYTFT | SYVMH | WVKQKPGQGLEWIG | YINPYNDGTKYNEKFKG | KATLTSDKSSSTAYMELLSSLTSEDSAVYYCAR | LRSRAMDY | WGQGTSVTVSS | 187 |
| SC16.73 | QVQLQQSGAELMKPGASVKISCKANGYTFS | SYWIE | WLRQRPGHGLEWIG | EILPGSDNSNYNEKFKG | KATFTADTSSNTAYMQLSSLTSEESAVYYCTR | GLRRDGSYYYVMEH | WGQGTSVTVSS | 191 |
| SC16.78 | EVKLVESGGGLVKPGGSLKLSCAASGFTFG | RYVMS | WVRQTPEKKLEWVA | STSSGTTYYPDSVKG | RFTISRDNARNILYLQMSSLRSEDTAMYYCAR | VYYHYDDIFAY | WGQGTLVTVSA | 195 |
| SC16.79 | EVQLQQSGPELVKPGASVKISCKTSCGYTFT | EYTMH | WVKQSHGKSLEWIG | GINPNNGGTSYNQKFKG | KATLTVDKSSSTAYMELRSLTSEDSAVYYCAR | GPAWFAY | WGQGTLVTVSA | 199 |
| SC16.80 | EVQLQQSGPELVKPGGSKKKISCKASGYSFT | GYSMN | WVKQSHGKNLEWIG | LINPYSGGTYNQKFKG | KATLTVDKSSSTAYMELLSLTSEDSAVYYCAR | RSDYPLVY | WGQGTLVTVSA | 203 |
| SC16.81 | QVQLKESGPVLVAPSQSLSITCTVSGFSLT | SYGVH | WVRQPPGKGLEWLG | VIWAGGSTNYNSALMS | RLSISIKDNSKSQVFLKMNSLQTDDTAMYYCAK | QGNFYAMDY | WGQGTSVTVSS | 207 |
| SC16.84 | EVQLQQSGPELVKPGASMKISCKASGYSFT | GYTMN | WVKQSHGKNLEWIG | LINPYNGGTTYNQKFKG | KATLTVDKSSSTAYMELLSLTSEDSAVYYCAR | GYYGNYRRYFDV | WGAGITVTVSS | 211 |
| SC16.88 | QVQLQQSGAELARPGASVKLSCKASGYTCT | SYWMQ | WVKQRPGQGLEWIG | AIYPGDGDTRYTQKFKG | KATLTADKSSSTAYMQLSSLSSLASEDSAVYYCAR | GRRTEAWFAY | WGQGTLVTVSA | 215 |
| SC16.101 | QVTLKESGPGILQPSQTLSLTCSFSGFSLS | TSGMGVG | WIRQPSGKGLEWLA | HIWWDDVKKRYNPALKS | RLTISKDASSSQVFLKIASVDTAETATYYCAH | ILDRAYYFDY | WGQGTLTVTS | 219 |
| SC16.103 | QVTLKESGPGILKPSQTLSLTCSFSGFSLS | TSGMGIG | WIRQPSGKGLEWLA | HIWWDDDKYYNPSLKS | QLTISKDSSRNQVFLKITSVDTADTATYYCAR | RGTAYYFDY | WGQGTLTLVSS | 223 |
| SC16.104 | QVQLKESGPDLVQPSQTLSLTCTVSGFSLT | FYGVH | WVRQPPGKGLEWVG | TMGWDDKKYYNSALKS | RLSISRDTSKNQVFLKLSSLQTEDTAMYYCTR | GGTGFDY | WGQGTLTLVSS | 227 |
| SC16.105 | QVQLQQPGAELVKPGASVKLSCKASGYTFT | SYWMH | WVKQRPGQGLEWIG | VINPSNGRTNYNEKFKS | KATLTVDKSSSTAYMQLSSLTSEDSAVYYCAR | RRELGTLYAMDY | WGQGTSVTVSS | 231 |
| SC16.106 | QVQLKQSGPGLVAPSQSLFITCTVSGFSLT | SYEIN | WVRQPPGKGLEWLG | VIWTGGSTNYNSALIS | RLSISKDNSKSLVFLKMNSLQTDDTAIYYCVR | GVYAMDY | WGQGTSVTVSS | 235 |
| SC16.107 | EVQLQQSGPELVKPGASVKMSCKASGYTFT | NYVMH | WVKQAPGKGLKWMG | YINPYNDGTKYNEKFKG | KATLTSDKSSTTAYMALSSLTSEDSAVYYCAV | AYYSNWGFAY | WGQGTLVTVSA | 239 |
| SC16.108 | QVQLEESGAELARPGASVKLSCKASGYSYW | MQ | WIKQRPGQGLEWIG | AIYPGNGDTRYTQKFKG | KATLTADKSSSTAYMQLSSLASEDSAVYYCAR | SPAYYRYGEGYFDY | WGQGTLTVSS | 243 |
| SC16.109 | QIQLVQSGPELKKPGETVKISCKASGYTFT | NYGMN | WVKQAPGKGLKWMG | WINTYTGEPAYADDFKG | RFAFSLETSASAAYLQINNLKNEDTAITFCAN | MRPTRGFAY | WGQGTLGTVSA | 247 |
| SC16.110 | EVQLQQSGPGLVRTGASVKISCKASGYSFT | GYYMH | WVKQSHCKSLEWIG | YISCYNGATTYNQNFKG | KATFWDTSSSTAYMQFNSLTSEDSAVYYCAR | SDGGHAMDY | WGQGTSVTVSS | 251 |
| SC16.111 | EVQLQQSGPELEKPGASVKISCKASGYSFT | GYNMN | WVKGSNGKSLEWIG | NIDPYYGSSYKQKFEG | KATLTVDKSSSTAYMQLKSLTSEDSAVYYCAR | GGSNFDY | WGQGTLTVSS | 255 |

FIG. 6B cont.

Amino Acid Sequences of Exemplary Murine Anti-DLL3 Antibody Heavy Chain Variable Regions

| mAb | FR1 | CDR1 | FR2 | CDR2 | FR3 | CDR3 | FR4 | SEQ ID NO. |
|---|---|---|---|---|---|---|---|---|
| SC16.113 | DVKLVESGGGLVKPGGSLKLSCAASGFTFS | SYTMS | WVRQTPEKRLEWVA | TISSGGSYPYYPDSVKG | RFTISRDNAKNTLYLQMSSLKSEDTAMYYCTR | DVYDGYSY | WGQGTLVTVSS | 259 |
| SC16.114 | EVQLQQSGAELVKPCASVKLSCTASGFNIK | DTYIH | WVKQRPEQGLEWIG | RIDPANGNTKYDPKFQG | KATITPDTSSNTAYLQLSSLTSEDTAVYYCAR | SWRNYGSSFWYFDV | WGAGTLVTVSS | 263 |
| SC16.115 | DVKLVESGGGLVKPCGSLKLSCAASGFTFS | SYTMS | WVRQTPEKRLEWVA | TISSGGSYPYYPDSVKG | RFTISRDNAKNTLYLQMSSLKSEDTAMYYCTR | DVYDGYSY | WGQGTTLTVSS | 267 |
| SC16.116 | QVQLKQSGPGRVQPSQSLSITCTVSGFSLT | SNGVH | WVRQSPGKGLEWLG | VIWSGGSTDYNAAFIS | RLSISKDNYKSQVFFKMNSLQANDTAIYYCAR | NNNRYGAMDY | WGQGTSVTVSS | 271 |
| SC16.117 | QVQLKESGPGLVAPSQSLSITCTVSGFSLT | NYGVH | WVRQPPGKGLEWLG | VIWAGGITNYNSALMS | RLSISEDNSKSQVFLKIMNSLQTDDTAMYYCAR | NLGPYAMDY | WGQGTSVTVSS | 275 |
| SC16.118 | EVQLQQSGPDLVKPGASVKVSCKASGYSFT | GYYMH | WYKQSHGKSLEWIG | RVNPNNGGTSYNQKFKG | KAILTADKSSSTAYMELRSLTSEDSAVYYCAR | GSYDYAEG | WGQGTLVTVSA | 279 |
| SC16.120 | EIQLQQSGPELVKPGASVKVSCKASGYAFT | SYNMY | WVMQSHGKSLEWIG | YDPYNGGTSYNQKFKG | KATLTVDKSSSTAYMHLNSLTSEDSAVYYCAR | ENYRYFDY | WGQGTTLTVSS | 283 |
| SC16.121 | EVQLVESGGGLVQPGKGLVQPGKGLEWVA | TYAMN | WVRQAPGKGLEWVA | RIRIKSNNYATYYADSVKD | RFTISRDDSGNMLYLQMNNLKTEDTAVYYCVR | QGYSYDWGPWFAY | WGQGTLVTVSA | 287 |
| SC16.122 | EVQLVESGGGLVKPCGSLKLSCAASGFTFS | DYYMF | WVRQTPEKRLEWVA | TISDGGSYTYFPDSVKG | RFTISRDNAQNNLYLQMSSLKSEDTAMYYCAR | AGTLYAMDY | WGQGTSVTVSS | 291 |
| SC16.123 | QYALKESGPSILQPSQTLSLTCSFSGFSLS | TSGMGVG | WIRQPSGKGLEWLA | HIWWDDVKRYNPALKS | RLTISKDTSSSQVFLKIASVDTADTATYYCAR | MEDYGSSSYFDF | WGHGTTLTVSS | 295 |
| SC16.124 | EVQLQQSGPELVKPGASVKMSCKASGYTFT | SYVMH | WVKQKPGQGLEWIG | YINPYNDGTKYNEKFKG | KATLTSDKSSSTAYMELSSLTSEDSAVYYCAR | GALYYGNYLGYFDV | WGAGTTVTVSS | 299 |
| SC16.125 | DVQLQESGPDLVKPSQSLSLTCTVTGYSIT | SGYSWH | WIRQFPGNKLEWMG | YIHYSGSTNYNPSLKS | RISITRDTSKNQFFLQFKGVTTEDSATYYCAL | EGNYDGFAY | WGQGTLVTVSS | 303 |
| SC16.126 | QVQMKESGPGLVAPSQSLSITCTVSGSSLT | NYGVH | WVRQPPGKGLEWLG | VIWAGGSTNYNSALMS | RLSISKDNSKSQVFLKMNSLQTDDTAMYYCAR | DWEGWFAY | WGQGTLVTVSA | 307 |
| SC16.129 | QVQLKESGPGLVAPSQSLSITCTVSGFSLT | DYGVS | WIRQPPGKGLEWLG | VIWGGGSTYYNSALKS | RLSISKDNSKSQVFLELNSLQTDDTAIYYCAK | HYGHYAAY | WGQGTLVTVSA | 311 |
| SC16.130 | EVQLQQSGPELVKPGASVKMSCKASGYTFT | SYVMH | WVKQKPGQGLEWIG | YINPYNDGTEYNEKFKG | KATLTSDKSSSTAYMELSSLTSEDSAVYYCAR | GVYDGYSYFDY | WGQGTTLTVSS | 315 |
| SC16.131 | QVQLKESGPGLVAPSQSLSTCTVSGFSLT | NYGVH | WVRQPPGKGLEWLG | VIWAGGITNYNSALMS | RLSISEDNSKSQVFLKMNSLQTDDTAMYYCAR | NLGPYAMDY | WGQGTSVTVSS | 319 |
| SC16.132 | QVQLKESGPGLVAPSQSLSTCTVSGFSLT | DYGVS | WIRQPPGKGLEWLG | VVWGGGSTYYNSALKS | RLSITKDNSKSQVFLKMNSLQTDDTAMYYCAK | QRGQYGAY | WGQGTLVTVSA | 323 |
| SC16.133 | QVQLKESGPGLVAPSQSLSITCTVSGFSLT | NYAVH | WVRQSPGKGLEWLG | VIWSDGSTDYNAAFIS | RLSISKDNSKSQVFFKMNSLQADDTAMYYCAR | KKGGWFPWFAY | WGQGTLVTVSA | 327 |
| SC16.134 | EVQLQQSGPDLVKPGASVKISCKASGYSFT | GYYMH | WVKQSHGKRLEWIG | RVNPNNGGTNYNQKFKG | KAILTVDKSSSTAYMELTSEDSAVYYCAR | GSYDNAEG | WGQGTLVTVSA | 331 |
| SC16.135 | QVQLQQSGAELVRPSTSVKVSCKASGYAFT | NYLIE | WVKQRPGQGLEWIG | VINPGSGGTNSNEKFKA | KATLTADKSSSTAYMQLSSLTSADSAVYFCAR | SDYDYAFYAMDY | WGQGTSVTVSS | 335 |
| SC16.136 | EVQLQQSGPELVKPGASVKMSCKASGYTFT | SYVMH | WVKQKPGQGLEWIG | YINPYNDGTKYNEKFKG | KATLTSDKSSSTAYMELSSLTSEDSAVYYCAR | DRSGYEDYGMDY | WGQGTSVTVSS | 339 |

FIG. 6B cont.

Amino Acid Sequences of Exemplary Murine anti-DLL3 Antibody Heavy Chain Variable Regions

| mAb | FR1 | CDR1 | FR2 | CDR2 | FR3 | CDR3 | FR4 | SEQ ID NO. |
|---|---|---|---|---|---|---|---|---|
| SC16.137 | EVQLVESGGDLVKPGGSLKLSCAASGFTFS | SYGMS | WVRQTPDKRLEWVA | TISSGGSYTYYPDSVKG | RFTISRDNAKNTLYLQMSSLKSEDTAMYYCAR | RRADAMDY | WGQGTSVTVSS | 343 |
| SC16.138 | QVQLKESGPGLVAPSQSLSITCTVSGFSLT | DYGVS | WIRQPPGKGLEWLG | VYWGGGSTYYNSALKS | RLSISKDNSKSQVFLKMNSLQTDDTAMYYCAK | QRGGYGAY | WGQGTLVTVSA | 347 |
| SC16.139 | EVQLQQSGPELVKPGASVKMSCKASGYTFT | NYVMH | WVKQKPGQGLEWIG | YINPYNDGTKYNEKFKG | KATLTSDKSSTTAYMALSSLTSEDSAVYYCAV | AYYSNWGFAY | WGQGTLVTVSA | 351 |
| SC16.140 | QVQLQQSGPELVRPGASVKMSCKASGYTFT | SYWMH | WVKQRPGQGLEWIG | MIDPSNSETRLNQKFKD | KATLNVDKSSNTAYMQLSSLTSEDSAVYYCAV | MDYYFDY | WGQGTLTVSS | 355 |
| SC16.141 | QVQLKQSGPGLVAPSQSLFITCTVSGFSLT | SYEIN | WVRQPPGKGLEWLG | VIWTGGSTNYNSALIS | RLSISKDNSKSLVFLKMNSLQTDDTAIYYCVR | GVYAMDY | WGQGTSVTVSS | 359 |
| SC16.142 | EVQLQQSGPELVKPGASVKSCKASGYTFT | DYNMH | WVKQSHGKSLEWIG | FFYPNGNTVYSQKFKS | KATLTVDNSSSTAYMELRSLTSEDSAVYYCAR | LNWEGY | WGQGTTL_TVSS_ | 363 |
| SC16.143 | QVQLQQSGPELVKPGASVRISCKASGYTFT | SYYIH | WVKQRPGQGLEWIG | WINPGNGNTKYNEKFKG | KATLTADKSSSTAYMQISSLTSEDSAVYFCAR | ERWLLLWFAY | WGQGTLVTVSS | 367 |
| SC16.144 | QIQLVQSGPELKKPGETVKISCKASGYTFT | NYGMN | WVKQAPGKGLKWVG | WINTYTGEPTYADDFKG | RFAFSLETSASTAYLQIDNLKNEDTATYFCAR | VGDYVGFDY | WGQGTLVTVSS | 371 |
| SC16.147 | QIQLVQSGPELTKPGETVKISCKASGYTFT | DYSLH | WVKQALGKGLKWMG | WINTETGEPAYADDFKG | RFAFSLETSASTAYLQINDLKNEDTTTYFCGI | YDGYAMDY | WGQGTSVTVSS | 375 |
| SC16.148 | QIQLVQSGPELKKPGETVKISCKASGYTLT | NYGMN | WVKQAPGKGLKWMG | WINTYTGEPTYADDFKG | RFAFSLETSARIVYLQINNLKNEDTATYFCAK | YEAHEGFVY | WGQGTLVTVSA | 379 |
| SC16.149 | QVQLKESGPGLVAPSQSLSITCAVSGFSLT | SFGVH | WVRQPPGKGLEWLG | VIWAGGSTNYYSALMS | RLSISIDNSKSCVFLKMINSLQTDDTAMYYCAR | DWEGWFAY | WGQGTLVTVSA | 383 |
| SC16.150 | EIQLQQSGPELVKPGASYKVSCKASGYAFT | SYNMY | WVSQSHGKSLEWIG | YIDPYNGGTSYNQKFRG | KATLTVDKSSSTAYMHLNSLTSEDSAVYYCAR | ENYRYFDF | WGQGTLTVSS | 387 |

FIG. 6B cont.

Amino Acid Sequences of Exemplary Humanized Anti-DLL3 Antibody Heavy Chain Variable Regions

| mAb | FR1 | CDR1 | FR2 | CDR2 | FR3 | CDR3 | FR4 | SEQ ID NO. |
|---|---|---|---|---|---|---|---|---|
| hSC16.13 | QITLKESGPTLVKPTQTLTLTCTFSGFSLS | TSGMGVG | WIRQPPGKALEWLA | HIWWDDVKRYSPSLKS | RLTITKDTSKNQVVLTMTNMDPVDTATYYCAR | IVSFDNDVVSAMDY | WGQGTLVTVSS | 391 |
| hSC16.15 | QVQLVQSGAEVKKPGASVKVSCKASGYTFT | RYWIH | WIRQAPGQGLEWMG | YINPTTVYTEFNQNFKD | RVTMTRDTSTSTVYMELSSLRSEDTAVYYCAR | GGSNFFDY | WGQGTTVTVSS | 395 |
| hSC16.25 | QITLKESGPTLVKPTQTLTLTCTFSGFSLS | TSGMGVG | WIRQPPGKALEWLT | DIWWDDNKYYNPSLKS | RLTITKDTSKNQVVLTMTNMDPVDTATYYCAR | RVNYYDPYYAMDY | WGQGTLVTVSS | 399 |
| hSC16.34 | QVQLVQSGAEVKKPGASVKVSCKASGYTFT | NYGMN | WVRQAPGQGRLEWMG | WINTYTGDPTYADDFKG | RVTITRDTSASTAYMELSSLRSEDTAVYYCAR | IGGNSPSDY | WGQGTVTVSS | 403 |
| hSC16.56 | QVQLVQSGAEVKKPGASVKVSCKASGYTFT | NYGMN | WVRQAPGQGLEWMG | WINTYTGEPTYADDFKG | RVTMTTDTSTSTAYMELRSLRSDDTAVYYCAR | IGDSSPSDY | WGQGTLVTVSS | 407 |

FIG. 6B cont.

DLL3 Protein Expression using Immunohistochemistry

| Melanoma Line | DLL3 Expression on p0 | DLL3 Expression on PDX | Mouse IgG2a |
|---|---|---|---|
| MEL7 | - | ND | - |
| MEL8 | +, 50%, c/m | ND | - |
| MEL17 | +++, 95%, c/m | ND | - |
| MEL18 | +++, 85%, c/m | ND | - |
| MEL19 | +++, 75%, m/c | ++, 10%, m/c | - |
| MEL20 | - | +/++, 10%, c/m | - |
| MEL26 | - | - | - |
| MEL28 | - | ND | - |
| MEL30 | ++/+++, 20%, m/c | - | - |
| MEL32 | - | - | - |
| MEL37 | +/++, 40%, c/m | ND | - |
| MEL38 | - | - | - |
| MEL43 | - | - | - |
| MEL48 | +/+++, 10%, c/m | ++, 60%, c/m | - |
| MEL50 | - | ND | - |
| MEL51 | - | - | - |
| MEL54 | - | ND | - |
| MEL63 | - | - | - |
| MEL66 | +/+++, 70%, c/m | +/++, 30%, c/m | - |
| MEL79 | - | - | - |

FIG. 9

Positively Correlated Surrogate Biomarkers for the Expression of DLL3 Protein in Melanoma

| Gene Symbol | Correlation with DLL3 | Gene Symbol | Correlation with DLL3 |
|---|---|---|---|
| DLL3 | 1.000 | ZNF417 | 0.618 |
| PUS7 | 0.777 | ATOH8 | 0.618 |
| EFHD1 | 0.709 | ATP6V1C1 | 0.618 |
| PTP4A3 | 0.688 | RPS10 | 0.617 |
| MYO1B | 0.675 | RPS19 | 0.617 |
| NFATC1 | 0.659 | BCL7A | 0.617 |
| NUDT14 | 0.657 | CHRNB2 | 0.614 |
| NR6A1 | 0.657 | CAMKK1 | 0.612 |
| JAG2 | 0.654 | SNORA43 | 0.611 |
| HAUS5 | 0.652 | TMEM117 | 0.610 |
| ADAT3 | 0.649 | CBLL1 | 0.609 |
| PAFAH1B3 | 0.648 | HSPA12B | 0.609 |
| CCDC136 | 0.645 | OR4C46 | 0.606 |
| GAS5 | 0.643 | ZNF419 | 0.605 |
| PPFIA3 | 0.643 | ZNF570 | 0.604 |
| CDK8 | 0.639 | FANCF | 0.603 |
| ZNF114 | 0.637 | ZNF480 | 0.602 |
| KHSRP | 0.637 | TRPM6 | 0.601 |
| MURC | 0.634 | CHD7 | 0.601 |
| ZNRD1 | 0.634 | | |
| RPS19 | 0.631 | | |
| LRRC43 | 0.630 | | |
| ZCCHC3 | 0.627 | | |
| LIN9 | 0.624 | | |

FIG. 12A

Anti-Correlative Surrogate Biomarkers for the Expression of DLL3 Protein in Melanoma

| Gene Symbol | Correlation with DLL3 |
|---|---|
| ZBTB20 | -0.600 |
| GPR155 | -0.604 |
| MST1 | -0.605 |
| CLVS1 | -0.607 |
| P4HA2 | -0.608 |
| CIITA | -0.612 |
| ITPR2 | -0.613 |
| BRK1 | -0.615 |
| TGOLN2 | -0.616 |
| TADA3 | -0.618 |
| SLC38A11 | -0.620 |
| KCNQ1 | -0.620 |
| TMED6 | -0.621 |
| NRXN3 | -0.636 |
| SNX24 | -0.640 |
| OLFML3 | -0.647 |
| KCT2 | -0.649 |
| PJA2 | -0.649 |
| SEPT8 | -0.682 |

FIG. 12B

Mutation Analysis of Melanoma PDX

| | # of DLL3 Positive PDX with mutations (n=14) | # of DLL3 Negative PDX with mutations (n=18) |
|---|---|---|
| BRAF | 4 V600E, 1 V600R | 8 V600E, 1 V600K |
| NRAS | 1 Q61R | |
| KIT | 1 L576P | |
| TP53 | 4 point mutations | 1 point mutation; 1 CNV-loss |
| CDKN2A | 7 point mutations; 5 CNV-loss | 1 point mutation; 8 CNV-loss |
| PTEN | 3 point mutations | 4 point mutations; 2 CNV-loss |
| ARID2 | 2 point mutations | 2 point mutations |
| PIK3CA | 2 point mutations | 2 point mutations |
| CTNNB1 | 1 point mutation | |
| KDR | | 1 C482R |
| MLL2 | | 2 point mutations |
| MECOM | 5 point mutations | 3 point mutations |
| MLL3 | 1 point mutation | 2 point mutations |
| NF1 | 4 point mutations | 2 point mutations |
| PTPRK | 1 point mutation | 1 point mutation |
| TRRAP | 2 point mutations | |

FIG. 13

*In Vivo* Treatment of Melanoma PDX with Anti-DLL3 ADCs Reduces the Frequency of Cancer Stem Cells

ANTI-DLL3 ANTIBODIES AND DRUG CONJUGATES FOR USE IN MELANOMA

RELATED APPLICATIONS

Priority is claimed to U.S. Provisional Application No. 61/942,796 filed on 21 Feb. 2014, which is incorporated herein in its entirety.

SEQUENCE LISTING

This application contains a sequence listing which has been submitted in ASCII format via EFS-Web and is hereby incorporated by reference in its entirety. Said ASCII copy, created on Feb. 23, 2015, is named S69697_1200WO_SEQL_022315.txt and is 609 KB (624,296 bytes) in size

FIELD OF THE INVENTION

This application generally relates to methods of diagnosing, treating, monitoring and preventing melanoma using anti-DLL3 antibodies, anti-DLL3 antibody drug conjugates and compositions thereof.

BACKGROUND OF THE INVENTION

Skin cancer, the most common form of cancer, is comprised of keratinocyte cancers (basal and squamous cell carcinomas), which are derived from the epithelial tissues of the skin; and melanoma, which is derived from pigment-producing melanocytes that reside in the skin and other parts of the body. Melanoma accounts for less than 5% of skin cancers but is responsible for 80% of skin cancer-related deaths. If diagnosed early at a cutaneous localized stage, surgical resection can usually cure the disease. Thus for stage I melanoma the prognosis is fairly good, with a five year survival rate of over 90%. However, the prognosis worsens the deeper the lesion extends beneath the skin because of melanoma's propensity to invade and metastasize. Metastatic melanoma remains one of the most difficult cancers to treat and surgical resection is not generally a curative treatment option. The five year survival rate for Stage IV melanoma is 15% to 20%. Worldwide, the incidence of melanoma has increased at an alarming rate, with a lifetime risk of developing melanoma as high as 1/58 for males in the U.S. to 1/25 for males in Australia. The increased incidence in recent decades is partly explained by altered sun exposure habits of the population, but several hereditary risk factors are also known.

The development of melanoma is complex and is related to environmental and genetic factors. Pigmentary characteristics are strongly correlated with melanoma incidence, with a higher risk in Type I skin types than Type VI skin types as defined by the Fitzpatrick scale. Other important risk factors are the number of pigment nevi (common moles), the number of dysplastic nevi and familial history of malignant melanomas. Mutations in the MAPK pathway have been shown to be very important in melanoma development; up to 90% of melanomas and benign melanocytic neoplasms carry activating mutations in either BRAF or NRAS. BRAF mutations occur in approximately 50% of primary cutaneous melanomas and up to 70% of malignant melanomas (Thomas et al., 2004, PMID: 15140228), where 80% of those mutations are a valine to glutamate change at position 600 (V600E) (Davies et al., 2002, PMID: 12068308.) NRAS mutations occur in approximately 20% of primary cutaneous melanomas. Recently developed treatments for melanoma have focused on these common genetic mutations that are associated with melanoma, e.g vemurafenib for BRAF V600E mutations. However, such therapeutics are ineffective on melanomas that are not characterized by the specific mutation. Furthermore many of these therapeutics provide some short term benefit but, for the most part, fail to provide a lasting cure that is free of tumor relapse or recurrence. There remains a great need to develop therapies that can be used to treat melanomas with various mutational characteristics and which provide a sustained remission.

SUMMARY OF THE INVENTION

The present invention discloses methods of diagnosing, prognosing, treating, monitoring and preventing melanoma, including refractory melanoma, using anti-DLL3 antibodies and antibody drug conjugates (ADCs), pharmaceutical compositions thereof, and articles of manufacture. In addition, disclosed herein are surrogate biomarkers for DLL3.

One aspect of the invention provides a method of assessing prognosis of a patient, the method comprising the steps of (a) determining a DLL3 expression level in a biological sample obtained from the patient; and (b) assessing a poor prognosis where the determined DLL3 expression level is above a threshold index value. In a related aspect is provided a method of selecting a patient for treatment, the method comprising the steps of (a) determining a DLL3 expression level in a biological sample obtained from the patient; and (b) selecting a patient for treatment using an anti-DLL3 antibody where the determined DLL3 expression level is above a threshold index value. In these methods, the step of determining a DLL3 expression level can comprise detecting DLL-3 protein expression, for example, using an anti-DLL3 antibody. The detection step can comprise any suitable technique known in the art, including immunohistochemistry. The threshold index value varies according to the technique used, as would be well understood in the art following a review of the instant disclosure. As one example, where immunohistochemistry is used as the detection method, the threshold index value will typically be greater than an H-Score of 70, 80, 90, 100, 120, 140, 160, 180, 200, 220, 240, 260, 280 and up to 300.

The disclosed methods for prognosis, patient selection, and/or detection of DLL3 levels can utilize any DLL3 antibody, including for example, an anti-DLL3 antibody comprising three CDRs of a light chain variable region amino acid sequence of SEQ ID NO: 173 and three CDRs of a heavy chain variable region amino acid sequence of SEQ ID NO: 175, or in particular aspects, an anti-DLL3 antibody comprising a light chain variable region amino acid sequence of SEQ ID NO: 173 and a heavy chain variable region amino acid sequence of SEQ ID NO: 175.

In addition, the disclosed methods for prognosis, patient selection, and/or detection of DLL3 levels can further comprise a treatment step of administering a therapeutically effective amount of an anti-DLL3 antibody drug conjugate as indicated by the instant disclosure. For example, in some aspects of the invention, the therapeutic antibody drug conjugate can comprise an internalizing antibody, and/or a chimeric antibody, a CDR-grafted antibody, or a humanized antibody. In particular aspects of the invention, the therapeutic antibody drug conjugate comprises an anti-DLL3 antibody comprising three CDRs of a light chain variable region amino acid sequence of SEQ ID NO: 149 and three CDRs of a heavy chain variable region amino acid sequence of SEQ ID NO: 151, or in particular aspects, an anti-DLL3 antibody comprising a light chain variable region amino acid sequence of SEQ ID NO: 405 and a heavy chain variable region amino acid sequence of SEQ ID NO: 407.

Another aspect of the invention provides a method of treating melanoma comprising administering an isolated anti-DLL3 antibody drug conjugate (ADC), or a pharmaceutically acceptable salt thereof, wherein the antibody drug conjugate (ADC) comprises the formula M-[L-D]n wherein M comprises an anti-DLL3 antibody; L comprises an optional linker; D comprises a pyrrolobenzodiazepine (PBD); and n is an integer from 1 to 20.

Melanoma is frequently characterized by the expression of oncogenes that have been activated through various point mutations (e,g, BRAF, NRAS, KIT) or tumor suppressor genes that have been silenced through various mechanisms (e.g. TP53, CDKN2A and PTEN.) The inventors have found that melanomas that express DLL3 do so independently of the most commonly annotated mutations of oncogenes and tumor suppressers in melanoma. These data indicate the possibility of treating melanoma patients who are also being treated with targeted agents (for example, vemurafenib, trametinib, dasatinib) or melanoma that is refractory to such treatments.

Thus, in one aspect of the invention, the methods of the invention can be used to treat refractory melanoma, including dacarbazine-refractory melanoma or vemurafenib-refractory melanoma.

In another aspect of the invention, the anti-DLL3 ADCs of the invention can be used to treat melanomas expressing wild type BRAF or to treat melanomas expressing mutated BRAF. In another aspect the anti-DLL3 ADCs of the invention can be used to treat melanomas expressing wild type NRAS or to treat melanomas expressing mutated NRAS.

In a particular aspect of the invention is provide a method of treating a subject having Stage II melanoma comprising the steps of (a) determining a DLL3 expression level in a biological sample obtained from the patient, wherein the determined DLL3 expression level is above a threshold index value; and (b) treating the patient with an anti-DLL3 antibody drug conjugate.

As disclosed herein, DLL3 expression has been found to be positively correlated with various genes expressed in melanoma. Thus, another aspect of the invention provides method of treating melanoma in a subject comprising the steps of (a) interrogating a biological sample obtained from the patient for one or more positively correlated surrogate biomarkers; (b) detecting expression of the one or more positively correlated surrogate biomarkers in the sample; and (c) treating the subject with a therapeutically effective amount of an anti-DLL3 antibody drug conjugate.

In a further aspect, the positively correlated surrogate biomarker is selected from the group consisting of one of the following markers PUS7, EFHD1, PTP4A3, MYO1B, NFATC1, NUDT14, NR6A1, JAG2, HAUS5, ADAT3, PAFAH1B3, CCDC136, GAS5, PPFIA3, CDK8, ZNF114, KHSRP, MURC, ZNRD1, RPS19, LRRC43, ZCCHC3, LIN9, ZNF417, ATOH8, ATP6V1C1, RPS10, RPS19, BCL7A, CHRNB2, CAMKK1, SNORA43, TMEM117, CBLL1, HSPA12B, OR4C46, ZNF570, FANCF, ZNF480, TRPM6, CHD7 and combinations thereof.

As disclosed herein, DLL3 expression has also been found to be anti-correlated with various genes expressed in melanoma thus, one aspect of the invention provides a method comprising the steps of (a) interrogating a biological sample obtained from the patient for one or more positively anti-correlative surrogate biomarkers; (b) detecting low or absent expression of the one or more anti-correlative surrogate biomarkers in the sample; and (c) treating the subject with a therapeutically effective amount of an anti-DLL3 antibody drug conjugate. Representative anti-correlative surrogate biomarkers include ZBTB20, GPR155, MST1, CLVS1, P4HA2, CIITA, ITPR2, BRK1, TGOLN2, TADA3, SLC38A11, KCNQ1, TMED6, NRXN3, SNX24, OLFML3, KCT2, PJA2, SEPT8, and combinations thereof.

The inventors have further discovered that certain biomarkers that are correlated with DLL3 are secreted and may therefore be useful in a diagnostic assay that uses a sample such as blood or serum, for example. Thus, another aspect of the invention provides a method of treating melanoma in a subject comprising subject comprising the steps of (a) interrogating a biological sample obtained from the patient for one or more secreted surrogate biomarkers; (b) detecting expression of the one or more secreted surrogate biomarkers in the sample; (c) and treating the subject with a therapeutically effective amount of an anti-DLL3 antibody drug conjugate. Representative biological samples include blood samples.

In a further aspect, the invention provides a method of treating melanoma in a subject comprising the steps determining expression of EFHD in a biological sample obtained from the patient, such as a blood sample, and if EFHD is expressed, then treating the subject with a therapeutically effective amount of an anti-DLL3 antibody drug conjugate. Another aspect of the invention provides a method of treating melanoma in a subject comprising the steps of determining expression of OLFML3 in a biological sample obtained from the patient, such as a blood sample, and if OLFML3 is found to be expressed, treating the subject with a therapeutically effective amount of an anti-DLL3 antibody drug conjugate (ADC).

A further aspect of the invention provides a method of treating melanoma in a subject comprising the steps of determining expression of JAG2 in a biological sample obtained from the patient, and if JAG2 has low expression, treating the subject with a therapeutically effective amount of an anti-DLL3 antibody drug conjugate (ADC).

A further aspect of the invention provides a method of treating melanoma in a subject comprising the steps of determining expression of NRXN2 in a biological sample obtained from the patient, and if NRXN2 has low expression, treating the subject with a therapeutically effective amount of an anti-DLL3 antibody drug conjugate (ADC).

The disclosed methods of treatment are practiced using an antibody drug conjugate comprising an anti-DLL3 antibody or antigen-binding fragment thereof. In some aspects of the invention, the anti-DLL3 antibody is an internalizing antibody, and/or a chimeric antibody, a CDR-grafted antibody, or a humanized antibody. For example, in the disclosed methods of treatment, the therapeutic antibody drug conjugate can comprise an anti-DLL3 antibody comprising three CDRs of a light chain variable region amino acid sequence of SEQ ID NO: 149 and three CDRs of a heavy chain variable region amino acid sequence of SEQ ID NO: 151, or in particular aspects, an anti-DLL3 antibody comprising a light chain variable region amino acid sequence of SEQ ID NO: 405 and a heavy chain variable region amino acid sequence of SEQ ID NO: 407.

The foregoing is a summary and thus contains, by necessity, simplifications, generalizations, and omissions of detail; consequently, those skilled in the art will appreciate that the summary is illustrative only and is not intended to be in any way limiting. This summary is not intended to identify key features or essential features of the claimed subject matter, nor is it intended to be used as an aid in determining the scope of the claimed subject matter.

BRIEF DESCRIPTION OF THE FIGURES

FIG. 4B shows patients having Stage I-IV melanoma and FIG. 4C shows patients stratified based on the staging of the melanoma.

FIG. 5 shows binning, domain mapping and affinity characteristics of exemplary anti-DLL3 antibodies.

FIGS. 6A and 6B provide contiguous amino acid sequences (SEQ ID NOS: 21-407, odd numbers) of light and heavy chain variable regions of exemplary murine and humanized anti-DLL3 antibodies.

FIG. 9 shows results of immunohistochemistry analysis using an anti-DLL3 monoclonal antibody, or a control mouse IgG2a antibody, on various primary MEL biopsy samples and MEL PDX, scored − (no expression) to +++ (high expression), in a calculated percentage of cells, with expression seen in the cytoplasm (c) or membrane (m).

FIG. 12 lists genes of surrogate biomarkers that are positively correlative (FIG. 12A) or anti-correlative (FIG. 12B) with DLL3 expression in MEL PDX.

FIG. 13 is a table that lists the number of MEL PDX that express DLL3 (left) or lack expression of DLL3 (right) and contain point mutations or copy number variation (CNV) in oncogenes or tumor suppressor genes commonly mutated in metastatic melanoma.

DETAILED DESCRIPTION OF THE INVENTION

Figure 1:
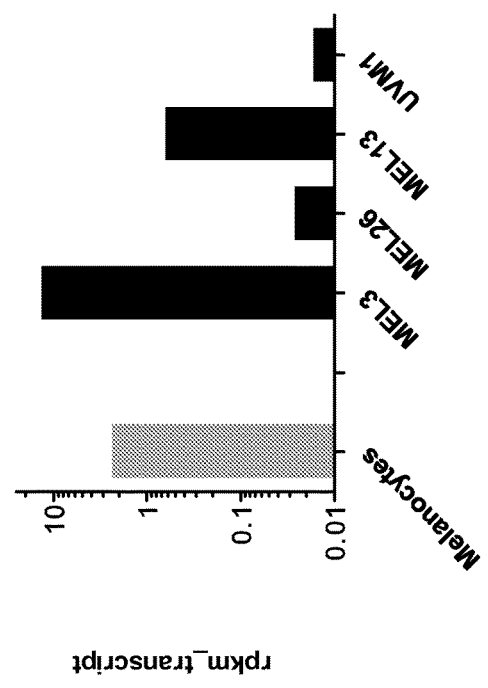
FIG. 1 depicts expression levels of DLL3 as measured using whole transcriptome (SOLiD) sequencing of RNA derived from cultured melanocytes, melanoma (MEL) tumor tissues and a uveal melanoma sample (UVM).

The invention may be embodied in many different forms. Disclosed herein are non-limiting, illustrative embodiments of the invention that exemplify the principles thereof. Any section headings used herein are for organizational purposes only and are not to be construed as limiting the subject matter described. For the purposes of the instant disclosure all identifying sequence accession numbers may be found in the NCBI Reference Sequence (RefSeq) database and/or the NCBI GenBank® archival sequence database unless otherwise noted.

The present invention provides the use of anti-DLL3 antibodies and ADCs for the prognosis, diagnosis, theragnosis, treatment and/or prevention of melanoma.

I. DLL3 Physiology

Delta-like 3 (DLL3; also known as SCDO1) is a member of the Delta-like family of Notch Delta-Serrate LAG2 (DSL) ligands. The Notch signaling pathway, first identified in *C. elegans* and *Drosophila* and subsequently shown to be evolutionarily conserved from invertebrates to vertebrates, participates in a series of fundamental biological processes including normal embryonic development, adult tissue homeostasis, and stem cell maintenance (D'Souza et al., 2010, PMID: 20816393; Liu et al., 2010, PMID: 20816402.) In humans there are four known Notch receptors and five DSL ligands: two homologs of Serrate, known as Jagged1 and Jagged 2, and three homologs of Delta, termed delta-like ligands or DLL1, DLL3 and DLL4.

Representative DLL3 protein orthologs include, but are not limited to, human (Accession Nos. NP_058637 (SEQ ID NO: 1) and NP_982353 (SEQ ID NO: 2)), chimpanzee (Accession No. XP_003316395), mouse (Accession No. NP_031892), and rat (Accession No. NP_446118). In humans, the DLL3 gene consists of 8 exons spanning 9.5 kBp located on chromosome 19q13. Alternate splicing within the last exon gives rise to two processed transcripts, one of 2389 bases (Accession No. NM_016941) and one of 2052 bases (Accession No. NM_203486). The former transcript encodes a 618 amino acid protein (Accession No. NP_058637), whereas the latter encodes a 587 amino acid protein (Accession No. NP_982353). These two protein isoforms of DLL3 share overall 100% identity across their extracellular domains (ECD) and their transmembrane domains, differing only in that the longer isoform contains an extended cytoplasmic tail containing 32 additional residues at the carboxy terminus of the protein. The biological relevance of the isoforms is unclear, although both isoforms can be detected in tumor cells (PCT/US2013/27391.)

In general, DSL ligands are composed of a series of structural domains: a unique N-terminal domain, followed by a conserved DSL domain, multiple tandem epidermal growth factor (EGF)-like repeats, a transmembrane domain, and a cytoplasmic domain not highly conserved across ligands but one which contains multiple lysine residues that are potential sites for ubiquitination by unique E3 ubiquitin ligases. The DSL domain is a degenerate EGF-domain that is necessary but not sufficient for interactions with Notch receptors. Additionally, the first two EGF-like repeats of most DSL ligands contain a smaller protein sequence motif known as a DOS domain that co-operatively interacts with the DSL domain when activating Notch signaling.

The ECD of the DLL3 protein comprises six EGF-like domains, a single DSL domain and an N-terminal domain. Generally, the EGF domains are recognized as occurring at about amino acid residues 216-249 (domain 1), 274-310 (domain 2), 312-351 (domain 3), 353-389 (domain 4), 391-427 (domain 5) and 429-465 (domain 6), with the DSL domain at about amino acid residues 176-215 and the N-terminal domain at about amino acid residues 27-175 of human DLL3. For the purposes of the instant disclosure the respective EGF-like domains may be termed EGF1 to EGF6 with EGF1 being closest to the N-terminal portion of the protein. In both iso forms of DLL3 the mature protein comprises a signal peptide of 26 amino acids that may be clipped prior to cell surface expression. Thus, in the mature protein the N-terminal domain will extend from position 27 in the protein until the beginning of the DSL domain.

Defects in the DLL3 gene have been linked to spondylocostal dysostosis in humans, a severe congenital birth defect resulting in abnormal vertebrae formation and rib abnormalities. This is linked to alterations in Notch signaling, known to play a crucial role in determining the polarity and patterning of somites, the embryonic precursors to the vertebrae that require a finely regulated oscillating interplay between Notch, Wnt, and FGF signaling pathways for proper development. Although DLL1 and DLL3 are typically expressed in similar locations within the developing mouse embryo, experiments with transgenic mice have demonstrated that DLL3 does not compensate for DLL1. DLL1 knock-out mice are embryonic lethal, but DLL3 mutant mice do survive yet show a phenotype similar to that found in humans with spondylocostal dysostosis. These data are consistent with a subtle interplay of Notch trans- and cis-interactions crucial for normal development.

In general, Notch receptors on the surface of the signal-receiving cell are activated by interactions with ligands expressed on the surface of an opposing, signal-sending cell (termed a trans-interaction). These trans-interactions lead to a sequence of protease mediated cleavages of the Notch receptor. As a result, the Notch receptor intracellular domain is free to translocate from the membrane to the nucleus, where it partners with the CSL family of transcription factors (RBPJ in humans) and converts them from transcriptional repressors into activators of Notch responsive genes. However, of the human Notch ligands, DLL3 is different in that it seems incapable of activating the Notch receptor via trans-interactions (Ladi et al., 2005, PMID: 16144902.) Notch signaling is critical for a variety of cell types during specification, patterning and morphogenesis. Frequently, this occurs through the mechanism of lateral inhibition, in which cells expressing Notch ligand(s) adopt a default cell fate, yet suppress this fate in adjacent cells via stimulation of Notch signaling. This binary cell fate choice mediated by Notch signaling is found to play a role in numerous tissues and takes place in the wider context of developmental and signaling cues that permit Notch signaling to trigger or inhibit proliferation or self-renewal.

Of the various Delta-like ligands, DLL3 is the most divergent from the others in the family, since it contains a degenerate DSL domain, no DOS motifs, and an intracellular domain which lacks lysine residues. The degenerate DSL and lack of DOS motifs are consistent with the inability of DLL3 to trigger Notch signaling in trans (between cells), suggesting that DLL3, unlike DLL1 or DLL4, acts only as an inhibitor of Notch signaling (Ladi et al., 2005, PMID: 16144902.) Studies have shown that DLL3 may be resident primarily in the cis-Golgi. Some DLL3 protein has been shown to be expressed at the cell surface in in vitro overexpression systems. (Ladi et al., 2005, PMID: 16144902.) However, it is not obvious that this would be the case in normal biological contexts nor in tumors in which the DLL3 mRNA transcript is elevated; somewhat surprisingly, it was shown that based on DLL3 protein expression levels in tumors, a significant amount of DLL3 protein does in fact appear to escape to the cell surface of various tumors (U.S.P.N. PCT/US2013/27391.)

II. Melanoma

The compositions and methods disclosed herein may be used to diagnose, monitor, treat or prevent melanoma. The term "melanoma", as used herein, includes all types of melanoma including, but not limited to, primary melanoma, malignant melanoma, cutaneous melanoma, extracutaneous melanoma, superficial spreading melanoma, polypoid melanoma, melanocarcinomas, melanoepitheliomas, melanosarcomas, melanoma in situ, nodular malignant melanoma, lentigo maligna melanoma, lentiginous melanoma, lentiginous malignant melanoma, mucosal lentiginous melanoma, mucosal melanoma, acral lentiginous melanoma, soft tissue melanoma, ocular melanoma, invasive melanoma, familial atypical mole and melanoma (FAM-M) syndrome, desmoplastic malignant melanoma or uveal melanoma.

Metastatic melanoma may be derived from melanocytes, melanocytic nevi or dysplastic nevi and can evolve through different phases of tumor progression (e.g. radial growth phase or vertical growth phase). Melanoma can be caused by chromosomal abnormalities, degenerative growth and/or developmental disorders, mitogenic agents, ultraviolet radiation, viral infections, carcinogenic agents, various genetic mutations or abnormal expression of a gene.

1. Stages of Melanoma

Stage 0 melanoma is a very early stage disease known as melanoma in situ (Latin for "in place"). Patients with melanoma in situ are classified as TisN0M (tumor in situ). The tumor is limited to the epidermis with no invasion of surrounding tissues, lymph nodes, or distant sites. Melanoma in situ is considered to be very low risk for disease recurrence or spread to lymph nodes or distant sites.

Stage I melanoma is characterized by tumor thickness, presence and number of mitoses, and ulceration status. There is no evidence of regional lymph node or distant metastasis. Stage I melanomas are considered to be low-risk for recurrence and metastasis. There are two subclasses of Stage I melanoma: (i) Stage IA (T1aN0M0), where a tumor is less than or equal to 1 mm, no ulceration, and no mitoses; and (ii) Stage IB (T1bN0M0 or T2aN0M0), where a tumor is less than or equal to 1 mm, with ulceration or mitoses.

Stage II melanomas also are localized tumors characterized by tumor thickness and ulceration status. There generally is no evidence of regional lymph node or distant metastasis. With treatment, Stage II disease is considered to be intermediate-risk for local recurrence or distant metastasis. There are three subclasses of Stage II melanoma: (a)

Stage HA (T2bN0M0 or T3aN0M0), which includes (i) 2b, where the tumor is 1.01-2.0 mm thick, with ulceration; (ii) T3a, where the tumor is 2.01-4.0 mm thick, with no ulceration; (iii) N0, where the tumor has not spread to nearby lymph nodes; and (iv) M0, where the tumor has not spread to sites distant from the primary tumor; (b) Stage IIB (T3bN0M0 or T4aN0M0Stage IIB, T3bN0M0 or T4aN0M0), which includes (i) T3b, where the tumor is 2.01-4.0 mm thick, with ulceration; (ii) T4a, where the tumor is greater than 4.0 mm thick, with no ulceration; (iii) N0, where the tumor has not spread to nearby lymph nodes; and (iv) M0, where the tumor has not spread to sites distant from the primary tumor; and (c) Stage IIC (T4bN0M0), which includes (i) T4b, where the tumor is greater than 4.0 mm thick, with ulceration; (ii) N0, where the tumor has not spread to nearby lymph nodes; and (iii) M0, where the tumor has not spread to sites distant from the primary tumor.

Stage III melanomas are tumors that have spread to regional lymph nodes, or have developed in transit metastasis or satellites. There often is no evidence of distant metastasis. With treatment, Stage III disease is considered to be intermediate to high-risk for local recurrence or distant metastasis. Stage III melanomas generally are defined by the number of lymph nodes to which the tumor has spread, whether tumor spread to the lymph nodes is microscopic or macroscopic, the presence of in transit or satellite tumor, and whether the primary tumor that is the source of lymph node spread shows evidence of ulceration. The epidermis that covers a portion of the primary melanoma often is not intact. Ulceration is determined by microscopic evaluation of the tissue by a pathologist, not by what can be seen with the naked eye. Micrometastases are tiny tumors not visible to the naked eye. They can be detected by microscopic evaluation after sentinel lymph node biopsy or elective lymph node dissection. Macrometastases often can be felt during physical examination or seen with the naked eye when inspected by a surgeon or pathologist. Presence often is confirmed by lymph node dissection or when the tumor is seen to extend beyond the lymph node capsule.

Subclasses of Stage III melanoma include (a) Stage IIIA (T1-T4a N1aM0 or T1-T4aN2aM0), which include (i) T1-T4a, where the tumor is not ulcerated and ranges in size from less than 1.0 mm to more than 4.0 mm thick; (ii) N1a, where micrometastasis is diagnosed in 1 nearby lymph node; (iii) N2a, where micrometastasis is diagnosed in 2-3 nearby lymph nodes; and (iii) M0, where the tumor has not spread to sites distant from the primary tumor; (b) Stage IIIB (T1-T4bN1aM0, T1-T4bN2aM0, T1-T4aN1bM0, T1-T4aN2bM0, or T1-T4a/bN2cM0), which includes (i) T1-T4a, where the tumor is not ulcerated and ranges in size from less than 1.0 mm to more than 4.0 mm thick; (ii) T1-4-b, where the tumor is ulcerated and ranges in size from less than 1.0 mm to more than 4.0 mm thick; (iii) N1b, where macrometastasis is diagnosed in 1 nearby lymph node; (iv) N2b, where macrometastasis is diagnosed in 2-3 nearby lymph nodes; (v) N2c, where presence of in-transit metastases or satellite metastases; and (vi) M0, where the tumor has not spread to sites distant from the primary tumor; and (c) Stage IIIC (T1-4-bN1bN0, T1-4-bN2bM0, T1-4-aN3M0 or T1-4-bN3M0), which includes (i) T1-T4a, where the tumor is not ulcerated and ranges in size from less than 1.0 mm to more than 4.0 mm thick; (ii) T1-4-b, where the tumor is ulcerated and ranges in size from less than 1.0 mm to more than 4.0 mm thick; (iii) N1b, where macrometastasis is diagnosed in 1 nearby lymph node; (iv) N2b, where macrometastasis is diagnosed in 2-3 nearby lymph nodes; (v) N3, where metastasis in 4 or more lymph nodes, the presence of matted lymph nodes, or the combination of in-transit/satellite metastases and metastatic lymph nodes; and (vi) M0, where the tumor has not spread to sites distant from the primary tumor.

Stage IV melanomas often are associated with metastasis beyond the regional lymph nodes to distant sites in the body. Common sites of metastasis are to vital organs (lungs, abdominal organs, brain, and bone) and soft tissues (skin, subcutaneous tissues, and distant lymph nodes). Stage IV melanoma may be characterized by the location of the distant metastases; the number and size of tumors; and the serum lactate dehydrogenase (LDH) level. LDH is an enzyme found in the blood and many body tissues. Elevated LDH levels usually indicate that the tumor has spread to internal organs.

Stage IV melanomas generally do not include T or N classification, and include: (a) M1a, where the tumor has metastasized to distant skin, the subcutaneous layer or to distant lymph nodes and serum LDH is normal; (b) M1b, where the tumor has metastasized to the lungs and serum LDH is normal; and (c) M1c, where the tumor has metastasized to vital organs other than the lungs and serum LDH is normal, and there are any distant metastases with elevated LDH.

The anti-DLL3 antibodies and ADCs of the invention can be used to diagnose or treat patients exhibiting limited stage melanoma or extensive stage melanoma. In some embodiments of the invention the melanoma may be Stage I, Stage II, Stage III, Stage IV or Stage V melanoma as defined herein.

2. Mutational Status of Melanoma

Transformation of normal melanocytes into melanoma cells is accomplished by the activation of growth stimulatory pathways, typically leading to cellular proliferation and the inactivation of apoptotic and tumor suppressor pathways. Target genes implicated in cellular transformation and tumor progression are divided into two categories: oncogenes and tumor suppressor genes (also known as growth suppressor genes.) Activation of oncogenes by point mutation (e.g. RAF and RAS), amplification, translocation (e.g. MYC), or even insertion of non-eukaryotic sequences, yields oncogenes in which the normal control mechanisms that constrain the gene are undermined and cellular proliferation results. Inactivation of tumor suppressor genes occurs mainly through an allelic deletion followed by a point mutation of the contralateral allele. Alterations in oncogenes and tumor suppressor genes are prevalent in melanoma and various therapies are being developed to target these alterations.

The inventors have found that melanomas which express DLL3 do so independently of the most commonly annotated mutations of oncogenes and tumor suppressers in melanoma. Thus, the anti-DLL3 ADCs of the invention can be used to treat melanoma expressing wild type or mutated oncogenes. In some embodiments the anti-DLL3 ADCs of the invention are used to treat melanoma expressing wild type oncogenes, while in other embodiments the anti-DLL3 ADCs of the invention are used to treat melanoma expressing mutated oncogenes. Examples of oncogenes that are expressed in melanoma, either as a wild type or in mutated form, and can be treated with the anti-DLL3 ADCs of the invention are the RAF family (ARAF, BRAF, CRAF), BRAF (e.g. BRAF having the following mutations: V600E, R461I, I462S, G463E, G463V, G465A, G465E, G465V, G468A, G468E, N580S, E585K, D593V, F594L, G595R, L596V, T598I, V599D, V599E, V599K, V599R, V600K, A727V), RAS family (HRAS, KRAS, NRAS) (e.g. NRAS having the following mutations: G12C, G12R, G12S, G12A, G12D, G12V, G13R, G13C, G13A, G13D, G13V, Q61E, Q61L, Q61P, Q61R, Q61H, Q61K), MITF (e.g. MITF having the E318K mutations and various mechanisms leading to overexpression), MC (e.g. MC having the following mutations: V60L, R151C, R160W, D294H), c-Kit (e.g., activating point mutation or increased copy number), GRIN2A (e.g., various point mutations including some that alter ligand binding, ERBB4 (e.g., gain of function mutations predominantly in the extracellular domain), EGFR (e.g., point mutations and focal amplifications), AKT3 (e.g., copy number gain and point mutations), TGFβ2, WNTSA, RAC1 (e.g., P29S variant), PREX1 and PREX2 (e.g., mutation, amplification, rearrangement), BRCA2, BCL2, GNAQ (e.g., Q2094 GNA11 (e.g., R183), CDK4 (e.g., R24C and other mutations and amplifications), and/or MMP8 (e.g., S50F, P78S, K87N, G104R, E138Q). Examples of mutated tumor suppressor genes in melanoma in which one or both alleles are lost, silenced through epigenetic mechanisms, or mutated include CDKN2A/p16 (germline and somatic mutations), PTEN, TP53, BCLAF1 and RB1. Treatment of tumors having mutated tumor suppressor genes with anti-DLL3 antibodies of the invention is also contemplated herein.

In one embodiment the anti-DLL3 ADCs of the invention can be used to treat melanoma expressing wild type BRAF. In another embodiment the anti-DLL3 ADCs of the invention can be used to treat melanoma expressing mutated BRAF comprising, for example, a V600E mutation or a V600R mutation. In further embodiments the anti-DLL3 ADCs of the invention can be used to treat melanoma expressing wild type NRAS. In other embodiments the anti-DLL3 ADCs of the invention can be used to treat melanoma expressing mutated NRAS having, for example, a Q61K or Q61R mutation. In some embodiments the anti-DLL3 ADCs of the invention can be used to treat uveal melanoma expressing mutated BAP1, EIF1AX or SF3B1 genes.

The mutational status of various relevant genes in a primary MEL tumor or MEL patient derived xenograft (PDX) line may be determined by performing targeted re-sequencing of genomic DNA (gDNA). In an exemplary embodiment, targeted re-sequencing of gDNA may be performed using gDNA from each MEL PDX cell line to generate a library with the Ion AmpliSeq Library Kit 2.0 and a custom panel of AmpliSeq primers (Life Technologies) encompassing over 3000 amplicons of up to 250 bp, and covering coding and non-coding regions of multiple genes. Each sample may be ligated to an Ion Xpress Barcode Adapter (Life Technologies) to allow pooling of multiple samples for each sequencing run. Sequencing can then be performed on an Ion Torrent PGM machine (Life Technologies), and data analysis can be carried out to identify variations in sequence of melanoma-related genes that lead to changes at the gDNA, mRNA transcript and protein levels. In some embodiments, the mutational status of melanoma-related genes can be used as a surrogate biomarker (as described in more detail below) to determine whether there is a correlation between various genetic mutations and the expression of DLL3, which may be informative of the effectiveness of treating a tumor (e.g. MEL) with the anti-DLL3 antibodies or ADCs of the invention.

In one embodiment the mutational status of the melanoma oncogenes can be used to determine whether there is a correlation between genetic mutations and the response to treatment with the anti-DLL3 antibodies or ADCs of the invention. In further embodiments the mutational status of the melanoma oncogenes can be used to determine effective combination therapies (as described in more detail below.)

3. Melanoma Treatment

Methods and compositions herein, for example, the anti-DLL3 antibodies and ADCs of the invention may be useful for diagnosing, treating, preventing or staging melanoma in a subject or patient. A "subject" or "patient" may be human or may be a mammalian species, including mice rats or cynomolgus monkeys. Terms such as "treating" or "treatment" or "to treat" refer to both therapeutic effects that cure, slow down, lessen symptoms of, and/or halt progression of a diagnosed pathologic condition or disorder and prophylactic measures that prevent and/or slow the development of a targeted pathologic condition or disorder. Patients who may be treated include those suffering from melanoma; those prone to have melanoma; and those in whom melanoma is to be prevented.

Sentinel lymph node biopsy is the treatment that is typically recommended for Stage I tumors thicker than 1.0 mm and for any ulcerated tumors of any thickness. The purpose is to determine whether any cancer cells have spread to the sentinel node, the first lymph node to receive drainage from the primary tumor. The results of the biopsy may help guide the course of treatment. Sentinel node biopsy often is most accurate when it is performed before surgery that removes the tumor and the surrounding skin. Stage IA has 5-year survival of around 97% and a 10 year survival of around 97% whereas Stage HA has 5-year survival rate of around 92% and a 10 year survival rate of around 86%.

Patients with Stage I or II melanoma may be further staged with immunohistochemical (IHC) staining using molecular markers that may be used to determine the tumor of origin or the prognosis, for example, antibodies such as S100, HMB-45, Ki-67 (MIB1), MITF, MART-1/Melan-A, MUC18, PCNA, INK4A or cocktails of several antibodies may be used for staining (Ivan and Prieto, 2010, PMID: 20624128; Linos et al., 2011, PMID: 21657842; Rothberg et al. 2009, PMID: 19318635.) In some embodiments other histopathologic examination (e.g. hematoxylin and eosin staining) may be used for further staging of melanoma. In one embodiment of the invention the anti-DLL3 antibodies of the invention (e.g. SC16.65; SEQ ID NO.: 173 and 175) can be used for immunohistochemistry staining to determine the prognosis of Stage II or Stage III melanoma patients.

Surgery is a common treatment for Stage I melanoma. The goal of surgery is to remove any cancer remaining after the biopsy. The procedure is referred to as wide local excision. The surgeon removes the tumor, including the biopsy site, as well as a surgical margin, a surrounding area of normal-appearing skin and underlying subcutaneous tissue. The width of the margin taken depends upon the thickness of the primary tumor. Recent advances in surgery allow surgeons to take narrower margins than before, so a greater amount of normal skin is preserved.

In addition to biopsy and surgery as described for Stage I, Stage II treatment may include adjuvant therapy, which is a treatment given in addition to a primary cancer treatment, following surgery. Systemic therapies use substances that travel through the bloodstream to reach and affect cancer cells throughout the body. Treatments include interferons, natural proteins produced by the normal cells of most body tissues in response to viral infections and disease. Interferon therapies have been shown to help the body's immune system fight disease more effectively. Studies indicate that low-dose interferon alfa-2a, a manufactured form of interferon, consistently delays relapse in patients with Stage II melanoma and higher-risk Stage IIB disease, but does not extend overall survival. High-dose interferon alfa-2b has been shown to significantly prolong disease-free and overall survival in patients with high-risk Stage IIB and Stage III melanoma. Vaccines, like interferons, may help boost the immune system to fight the return of melanoma. Vaccine therapy has been investigated as a therapy for patients who cannot tolerate the side effects of immunotherapies, such as interferon. Stage HA has 5-year survival rate of around 81% and a 10 year survival rate of around 67%; Stage IIB has 5-year survival rate of around 70% and a 10 year survival rate of around 57%; Stage IIC has 5-year survival rate of around 53% and a 10 year survival rate of around 40%.

Figure 4A:
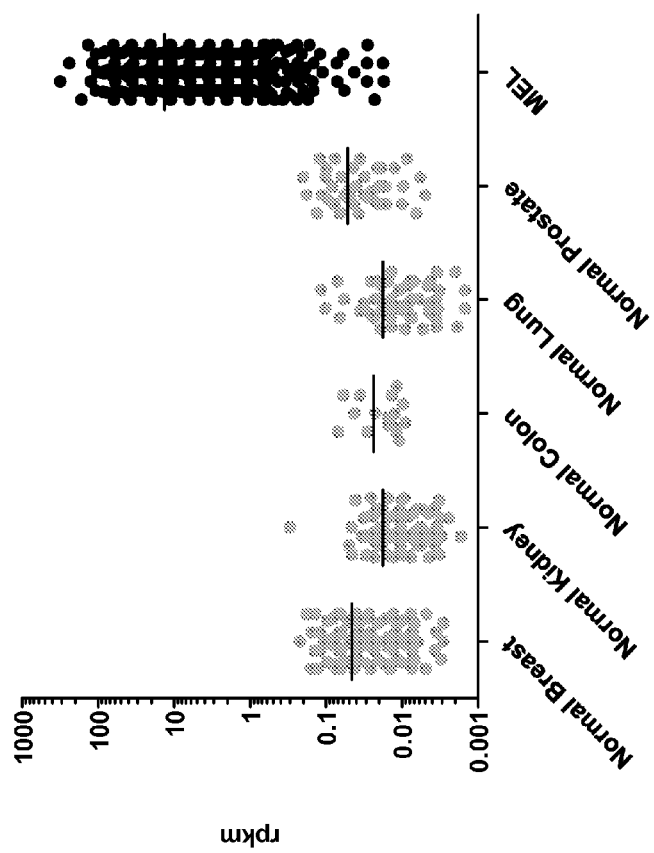
FIG. 4A shows expression of DLL3 transcripts in various normal tissues and primary melanoma tumors from The Cancer Genome Atlas (TCGA), a publically available dataset.
Figure 4B:
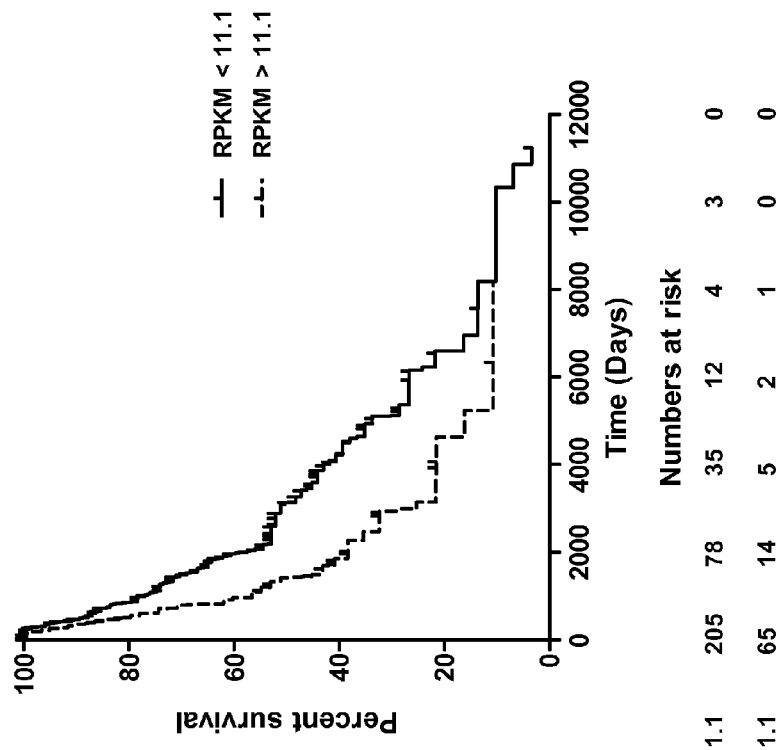
FIGS. 4B and 4C show Kaplan-Meier survival curves based on high and low expression of DLL3 transcripts in primary melanoma tumors from the TCGA dataset wherein the threshold index value is determined using the arithmetic mean of the RPKM values, where
Figure 4C:
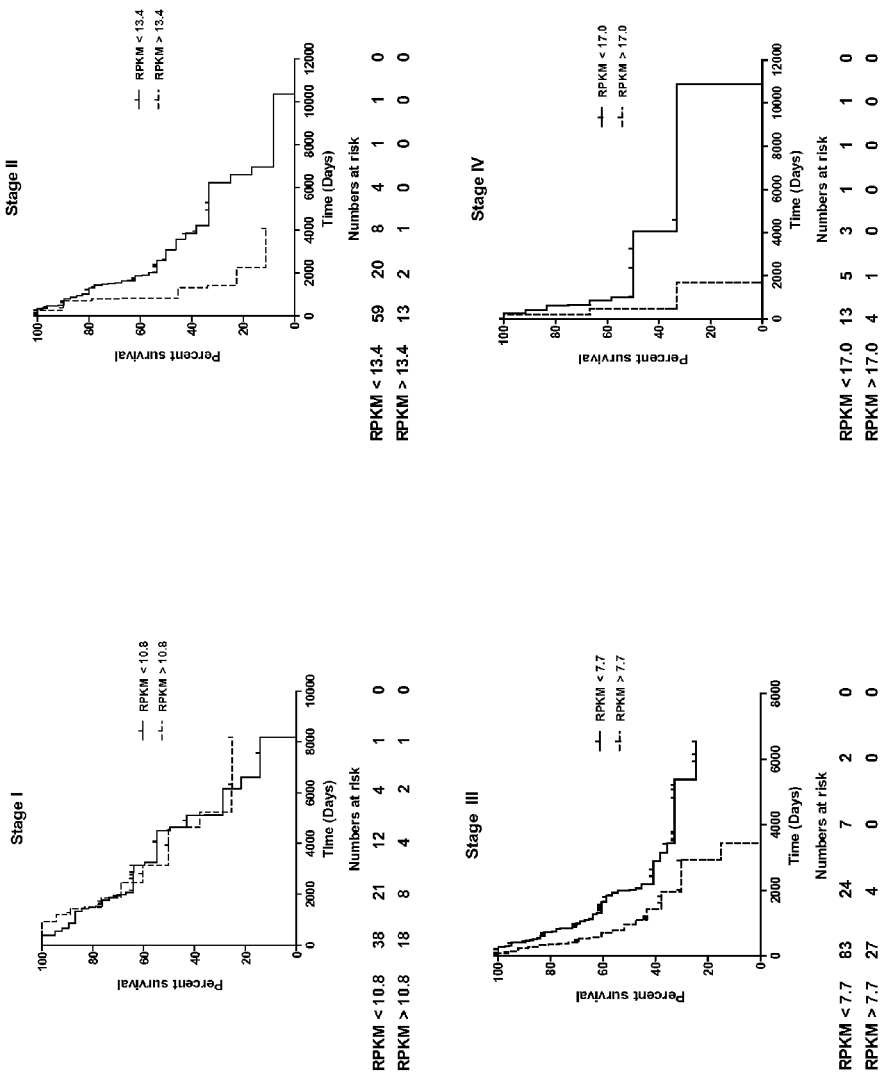

It has been determined that DLL3 is a prognostic marker of poor outcome in melanoma patients. Surprisingly, even in patients diagnosed with Stage II melanoma, for which resection and adjuvant therapy generally provide good outcomes, DLL3 expression is an indication of poor prognosis (See Example 4; FIGS. 4B and 4C). Thus, in one embodiment the invention discloses a method of treating a subject having Stage II melanoma comprising the steps of diagnosing Stage II melanoma in a subject, determining the expression of DLL3 in a biological sample obtained from the patient, and if such sample has DLL3 expression above a threshold index value, treating the subject with a therapeutically effective amount of an anti-DLL3 antibody drug conjugate.

Stage III melanoma treatment often includes surgery and adjuvant therapy as described above in addition to therapeutic lymph node dissection (TLND), which is surgery to remove regional lymph nodes from the area where cancerous lymph nodes were found. Such surgery is highly recommended for patients with macrometastases. The goal of the surgery is to prevent further spread of the disease through the lymphatic system. TLND also plays an important role in controlling the pain often caused by untreated lymph node disease. Lymphatic mapping and sentinel node biopsy generally are not recommended for patients with clinically diagnosed Stage III disease. These procedures may be recommended, however, for patients with certain subgroups of Stage III disease. Adjuvant radiation therapy has not been proven to be of benefit in randomized, controlled studies but is sometimes recommended when the tumor has grown outside the lymph nodes into the surrounding tissue (extracapsular spread). The goal is to control the further spread of the disease. Stage IIIA has 5-year survival rate of around 78% and a 10 year survival rate of around 68%; Stage IIIB has 5-year survival rate of around 59% and a 10 year survival rate of around 43%; Stage IIIC has 5-year survival rate of around 40% and a 10 year survival rate of around 24%.

No treatment so far has definitively shown to prolong survival or cure disease in Stage IV melanoma. Treatments instead focus on relieving uncomfortable symptoms caused by the disease. Treatments include: surgery to remove cancerous tumors or lymph nodes that have metastasized to other areas of the body, if they are few in number and are causing symptoms; established and experimental systemic therapies; and radiation therapy. Radian therapy generally is reserved for advanced cases where surgery is not possible or may be complicated, and for relieving symptoms of metastatic disease to the brain or bone. Stage IV has a 5-year survival rate of around 15% and a 10 year survival rate of around 24%.

In further embodiments the anti-DLL3 ADCs of the invention may be used to treat refractory melanoma. As used herein "refractory melanoma" means melanoma that is resistant to treatment or cure, or melanoma that has failed to respond to initial systemic therapy (chemotherapy and/or biologic therapy) and has progressed or recurred after an initial response to treatment or melanoma that has locally recurred (skin and/or regional lymph nodes) after initial surgery or surgery and adjuvant therapy. The anti-DLL3 ADCs of the invention can be used to treat refractory melanoma (e.g. dacarbazine-refractory melanoma or vemurafenib-refractory melanoma.)

In another embodiment the disclosed anti-DLL3 ADCs may be used in maintenance therapy to reduce or eliminate the chance of tumor recurrence following initial treatment. Preferably the disorder will have been treated by the disclosed anti-DLL3 ADCs or by other therapeutic agents and the initial tumor mass eliminated or reduced so the patient is asymptomatic or in remission. At such time the subject may be administered pharmaceutically effective amounts of the disclosed anti-DLL3 ADCs one or more times even though there is little or no indication of disease using standard diagnostic procedures.

The standard treatment for Stage I and II melanoma is wide excision (surgery to remove the melanoma as well as a margin of normal skin around it.) Stage I and II melanoma is non-metastatic and so a localized removal of the tumor tissue can be sufficient to remove the tumor. However, in one embodiment of the invention it has been found that melanoma expressing high levels of DLL3 is indicative of poor prognosis (FIG. In some embodiments of the invention, if the Stage I or II melanoma. In certain embodiments, a patient is successfully treated for melanoma according to the methods of the present invention if a measurable therapeutic effect is shown. A therapeutically effective amount of anti-DLL3 antibody or ADC will be sufficient to result in a measurable therapeutic effect. As used herein the term "measurable therapeutic effect" includes, but is not limited to, a reduction in the number of, or complete absence of, cancer or tumor cells; a reduction in the tumor size; inhibition of, or an absence of, cancer or tumor cell infiltration into peripheral organs including, for example, the spread of tumor into soft tissue and bone; inhibition of or an absence of tumor metastasis; inhibition of or an absence of tumor growth; cancer cell cytolysis; reduction of cancer cell antigens; relief of one or more symptoms associated with melanoma; reduced morbidity and mortality; improvement in quality of life; progression-free survival; reduction in the number or frequency of circulating tumor cells; reduction in tumorigenicity, tumorigenic frequency, or tumorigenic capacity of a tumor; reduction in the number or frequency of tumorigenic cells in a tumor; differentiation of tumorigenic cells to a non-tumorigenic state; or some combination of effects.

The phrase "substantially non-responsive" as used herein refers to a tumor or a cancer (e.g., melanoma) that shows no measurable therapeutic effect after administration of a therapeutic moiety. The phrase may also refer to a patient that shows stable disease or progressive disease after administration of a therapeutic agent. The phrase may be used when referring to tumors or cancers that are resistant to treatment with a therapeutic agent. The phrase "substantially non-responsive to at least one BRAF inhibitor" as used herein refers to a tumor or a cancer (e.g., melanoma) that shows stable growth or increased growth after administration of a BRAF inhibitor. In some embodiments the "BRAF inhibitor" is a small molecule compound inhibitor. In some embodiments, the BRAF inhibitor is vemurafenib or PLX4720. In some embodiments, the BRAF inhibitor is sorafenib. In some embodiments, the BRAF inhibitor is GDC-0879. In some embodiments, a BRAF inhibitor is administered to a patient in need of treatment, and the patient is "substantially non-responsive" to the BRAF inhibitor, meaning that the treatment will result in very few or no measurable therapeutic effects.

4. Combination Therapies

For the following discussion and as used generally herein the terms antibody and ADC are interchangeable in that the mention of one generally means that the other may be used in the same manner unless otherwise precluded by contextual limitations.

Combination therapies may be useful in preventing or treating melanoma and in preventing metastasis or recurrence of melanoma. "Combination therapy", as used herein, means treatment comprising a combination of at least one anti-DLL3 antibody or ADC and at least one therapeutic moiety (e.g., anti-cancer agents) and/or a surgical procedure (e.g. resection of a tumor), wherein the combination preferably has therapeutic synergy or improves the measurable therapeutic effects in the treatment of melanoma over (i) the anti-DLL3 antibody or ADC used alone, or (ii) the therapeutic moiety used alone, or (iii) the use of the therapeutic moiety in combination with another therapeutic moiety without the addition of an anti-DLL3 antibody or ADC. The term "therapeutic synergy", as used herein, means the combination of an anti-DLL3 antibody or ADC and one or more therapeutic moiety(ies) having a therapeutic effect greater than the additive effect of the combination of the anti-DLL3 ADC and the one or more therapeutic moiety(ies).

Desired outcomes of the disclosed combinations are quantified by comparison to a control or baseline measurement. As used herein, relative terms such as "improve," "increase," or "reduce" indicate values relative to a control, such as a measurement in the same individual prior to initiation of treatment described herein, or a measurement in a control individual (or multiple control individuals) in the absence of the anti-DLL3 antibodies or ADCs described herein but in the presence of other therapeutic moiety(ies) such as standard of care treatment. A representative control individual is an individual afflicted with the same form of melanoma as the individual being treated, who is about the same age as the individual being treated (to ensure that the stages of the disease in the treated individual and the control individual are comparable.)

Changes or improvements in response to therapy are generally statistically significant. As used herein, the term "significance" or "significant" relates to a statistical analysis of the probability that there is a non-random association between two or more entities. To determine whether or not a relationship is "significant" or has "significance," a "p-value" can be calculated. P-values that fall below a user-defined cut-off point are regarded as significant. A p-value less than or equal to 0.1, less than 0.05, less than 0.01, less than 0.005, or less than 0.001 may be regarded as significant.

A synergistic therapeutic effect may be an effect of at least about two-fold greater than the therapeutic effect elicited by a single therapeutic moiety or anti-DLL3 ADC, or the sum of the therapeutic effects elicited by the anti-DLL3 ADC or the single therapeutic moiety(ies) of a given combination, or at least about five-fold greater, or at least about ten-fold greater, or at least about twenty-fold greater, or at least about fifty-fold greater, or at least about one hundred-fold greater. A synergistic therapeutic effect may also be observed as an increase in therapeutic effect of at least 10% compared to the therapeutic effect elicited by a single therapeutic moiety or anti-DLL3 ADC, or the sum of the therapeutic effects elicited by the anti-DLL3 ADC or the single therapeutic moiety(ies) of a given combination, or at least 20%, or at least 30%, or at least 40%, or at least 50%, or at least 60%, or at least 70%, or at least 80%, or at least 90%, or at least 100%, or more. A synergistic effect is also an effect that permits reduced dosing of therapeutic agents when they are used in combination.

In practicing combination therapy, the patient may undergo surgery (e.g. tumor resection) prior to administration of the anti-DLL3 antibody or ADC and therapeutic moiety(ies) or during the course of administration of the anti-DLL3 antibody or ADC.

In addition, the anti-DLL3 antibody or ADC may be administered to the subject simultaneously, either in a single composition, or as two or more distinct compositions using the same or different administration routes. Alternatively, treatment with the anti-DLL3 antibody or ADC may precede or follow the therapeutic moiety treatment by, e.g., intervals ranging from minutes to weeks. In one embodiment, both the therapeutic moiety and the antibody or ADC are administered within about 5 minutes to about two weeks of each other. In yet other embodiments, several days (2, 3, 4, 5, 6 or 7), several weeks (1, 2, 3, 4, 5, 6, 7 or 8) or several months (1, 2, 3, 4, 5, 6, 7 or 8) may lapse between administration of the antibody and the therapeutic moiety.

The combination therapy can be administered until the condition is treated, palliated or cured on various schedules such as once, twice or three times daily, once every two days, once every three days, once weekly, once every two weeks, once every month, once every two months, once every three months, once every six months, or may be administered continuously. The antibody and therapeutic moiety(ies) may be administered on alternate days or weeks; or a sequence of anti-DLL3 antibody or ADC treatments may be given, followed by one or more treatments with the additional therapeutic moiety. In one embodiment an anti-DLL3 antibody or ADC is administered in combination with one or more therapeutic moiety(ies) for short treatment cycles. In other embodiments the combination treatment is administered for long treatment cycles. The combination therapy can be administered via any route before or after a surgical procedure (e.g. tumor resection.)

In some embodiments the anti-DLL3 antibodies or ADCs may be used in combination with various first line melanoma treatments. In one embodiment the combination therapy comprises the use of an anti-DLL3 antibody or ADC and dacarbazine and optionally one or more other therapeutic moiety(ies). In further embodiments the combination therapy comprises the use of an anti-DLL3 antibody or ADC and temozolamide and optionally one or more other therapeutic moiety(ies). In another embodiment the combination therapy comprises the use of an anti-DLL3 antibody or ADC and a platinum-based therapeutic moiety (e.g. carboplatin or cisplatin) and optionally one or more other therapeutic moiety(ies). In some embodiments the combination therapy comprises the use of an anti-DLL3 antibody or ADC and a vinca alkaloid therapeutic moiety (e.g. vinblastine, vinorelbine, vincristine, or vindesine) and optionally one or more other therapeutic moiety(ies). In one embodiment the combination therapy comprises the use of an anti-DLL3 antibody or ADC and interleukin-2 and optionally one or more other therapeutic moiety(ies). In another embodiment the combination therapy comprises the use of an anti-DLL3 antibody or ADC and interferon-alpha and optionally one or more other therapeutic moiety(ies).

In other embodiments, the anti-DLL3 antibodies or ADCs may be used in combination with adjuvant melanoma treatments and/or a surgical procedure (e.g. tumor resection.) In one embodiment the combination therapy comprises the use of an anti-DLL3 antibody or ADC and interferon-alpha and optionally one or more other therapeutic moiety(ies).

The inventors have discovered that melanomas that express DLL3 do so independently of the most commonly annotated mutations of oncogenes and tumor suppressers in melanoma (See Example 19). Thus the combination therapy may comprise an anti-DLL3 antibody or ADC and a targeted chemotherapeutic moiety that is effective in the treatment of melanomas expressing a mutated oncogene (e.g. BRAF V600E; BRAF V600K) or activated oncogene or protein (e.g. MEK), particularly genes in signal transduction pathways. In one embodiment the combination therapy comprises the use of an anti-DLL3 antibody or ADC and a BRAF targeted chemotherapeutic (e.g. vemurafenib or dabrafinib) and optionally one or more other therapeutic moiety(ies). In another embodiment, the combination therapy may comprise an anti-DLL3 antibody or ADC and a MEK inhibitor (e.g., trametinib) and optionally one or more other therapeutic moiety(ies). In yet another embodiment, the combination therapy may comprise an anti-DLL3 antibody or ADC and a KIT inhibitor (e.g., dasatinib, imatinib, or nilotinib).

T lymphocytes (e.g., cytotoxic lymphocytes (CTL)) play an important role in host defense against malignant tumors. CTL are activated by the presentation of tumor associated antigens on antigen presenting cells. Active specific immunotherapy is a method that can be used to augment the T lymphocyte response to melanoma by vaccinating a patient with peptides derived from known melanoma associated antigens. In one embodiment the combination therapy may comprise an anti-DLL3 antibody or ADC and a vaccine to a melanoma associated antigen (e.g. melanocyte-lineage specific antigen tyrosinase, gp100, Melan-A/MART-1 or gp75.) In other embodiments the combination therapy may comprise administration of an anti-DLL3 antibody or ADC together with in vitro expansion, activation, and adoptive reintroduction of autologous CTLs or natural killer cells. CTL activation may also be promoted by strategies that enhance tumor antigen presentation by antigen presenting cells. Granulocyte macrophage colony stimulating factor (GM-CSF) promotes the recruitment of dendritic cells and activation of dendritic cell cross-priming. In one embodiment the combination therapy may comprise the isolation of antigen presenting cells, activation of such cells with stimulatory cytokines (e.g. GM-CSF), priming with tumor-associated antigens, and then adoptive reintroduction of the antigen presenting cells into patients in combination with the use of anti-DLL3 antibodies or ADCs and optionally one or more different therapeutic moiety(ies).

Another approach to treating melanoma targets cytotoxic T lymphocyte-associated antigen 4 (CTLA4), a negative regulator of the antitumor T lymphocyte response (e.g., by using an anti-CTLA4 monoclonal antibody called ipilimumab). In one embodiment the combination therapy comprises the use of an anti-DLL3 antibody or ADC together with ipilimumab and optionally one or more other therapeutic moiety(ies). In another embodiment the combination therapy comprises the use of an anti-DLL3 antibody or ADC together with ipilimumab and a melanoma peptide vaccine. In yet another embodiment the combination therapy comprises the use of an anti-DLL3 antibody or ADC together with ipilimumab and GM-CSF.

PD-1, together with its ligand PD-L1, is another negative regulator of the antitumor T lymphocyte response. In one embodiment the combination therapy may comprise an anti-DLL3 antibody or ADC together with an anti-PD-L1 antibody (e.g. lambrolizumab, nivolumab) and optionally one or more other therapeutic moiety(ies). In another embodiment the combination therapy may comprise an anti-DLL3 antibody or ADC together with an anti-PD-L1 antibody (e.g. MPDL3280A, MEDI4736) and optionally one or more other therapeutic moiety(ies). In yet another embodiment, the combination therapy may comprise an anti-DLL3 antibody or ADC together with an anti PD-1 antibody (e.g., pembrolizumab) administered to patients who continue progress following treatments with other anti-PD-1 and/or targeted BRAF combination therapies (e.g., ipilimumab and vemurafenib or dabrafinib).

The invention also provides for the combination of anti-DLL3 antibodies or ADCs with oncolytic viruses engineered to infect and subsequently kill melanoma cells (e.g, telimogene laherparepvec). In one embodiment, the combination therapy may comprise an anti-DLL3 antibody or ADC together with telimogene laherparepvec and optionally one or more other therapeutic moiety(ies).

The invention also provides for the combination of anti-DLL3 antibodies or ADCs with radiotherapy. The term "radiotherapy", as used herein, means, any mechanism for inducing DNA damage locally within tumor cells such as gamma-irradiation, X-rays, UV-irradiation, microwaves, electronic emissions and the like. Combination therapy using the directed delivery of radioisotopes to tumor cells is also contemplated, and may be used in combination with or as a conjugate of the anti-DLL3 antibodies disclosed herein. Typically, radiation therapy is administered in pulses over a period of time from about 1 to about 2 weeks. Optionally, the radiation therapy may be administered as a single dose or as multiple, sequential doses.

In other embodiments an anti-DLL3 antibody or ADC may be used in combination with one or more of the chemotherapeutic agents described below.

5. Anti-Cancer Agents

The term "anti-cancer agent" or "chemotherapeutic agent" as used herein is one subset of "therapeutic moieties", which in turn is a subset of the agents described as "pharmaceutically active moieties". More particularly "anti-cancer agent" means any agent that can be used to treat a cell proliferative disorder such as cancer, and includes, but is not limited to, cytotoxic agents, cytostatic agents, anti-angiogenic agents, debulking agents, chemotherapeutic agents, radiotherapy and radiotherapeutic agents, targeted anti-cancer agents, biological response modifiers, therapeutic antibodies, cancer vaccines, cytokines, hormone therapy, anti-metastatic agents and immunotherapeutic agents.

The term "cytotoxic agent", which can also be an anti-cancer agent means a substance that is toxic to the cells and decreases or inhibits the function of cells and/or causes destruction of cells. Typically, the substance is a naturally occurring molecule derived from a living organism (or a synthetically prepared natural product). Examples of cytotoxic agents include, but are not limited to, small molecule toxins or enzymatically active toxins of bacteria (e.g., Diptheria toxin, *Pseudomonas* endotoxin and exotoxin, Staphylococcal enterotoxin A), fungi (e.g., α-sarcin, restrictocin), plants (e.g., abrin, ricin, modeccin, viscumin, pokeweed anti-viral protein, saporin, gelonin, momoridin, trichosanthin, barley toxin, *Aleurites fordii* proteins, dianthin proteins, *Phytolacca mericana* proteins (PAPI, PAPII, and PAP-S), *Momordica charantia* inhibitor, curcin, crotin, *saponaria officinalis* inhibitor, mitegellin, restrictocin, phenomycin, neomycin, and the tricothecenes) or animals, (e.g., cytotoxic RNases, such as extracellular pancreatic RNases; DNase I, including fragments and/or variants thereof).

An anti-cancer agent can include any chemical agent that inhibits, or is designed to inhibit, a cancerous cell or a cell likely to become cancerous or generate tumorigenic progeny (e.g., tumorigenic cells). Such chemical agents are often directed to intracellular processes necessary for cell growth or division, and are thus particularly effective against cancerous cells, which generally grow and divide rapidly. For example, vincristine depolymerizes microtubules, and thus inhibits cells from entering mitosis. Such agents are often administered, and are often most effective, in combination, e.g., in the formulation CHOP. Again, in selected embodiments such anti-cancer agents may be conjugated to the disclosed antibodies.

Examples of anti-cancer agents that may be used in combination with (or conjugated to) the antibodies of the invention include, but are not limited to, alkylating agents, alkyl sulfonates, amanitins, aziridines, ethylenimines and methylamelamines, acetogenins, a camptothecin, bryostatin, callystatin, CC-1065, cryptophycins, dolastatin, duocarmycin, eleutherobin, pancratistatin, a sarcodictyin, spongistatin, nitrogen mustards, antibiotics, enediyne antibiotics, dynemicin, bisphosphonates, esperamicin, chromoprotein enediyne antiobiotic chromophores, aclacinomysins, actinomycin, authramycin, azaserine, bleomycins, cactinomycin, carabicin, carminomycin, carzinophilin, chromomycinis, dactinomycin, daunorubicin, detorubicin, 6-diazo-5-oxo-L-norleucine, ADRIAMYCIN® doxorubicin, epirubicin, esorubicin, idarubicin, marcellomycin, mitomycins, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites, folic acid analogues, purine analogs, androgens, anti-adrenals, folic acid replenisher such as frolinic acid, aceglatone, aldophosphamide glycoside, aminolevulinic acid, eniluracil, amsacrine, bestrabucil, bisantrene, edatraxate, defofamine, demecolcine, diaziquone, elfornithine, elliptinium acetate, an epothilone, etoglucid, gallium nitrate, hydroxyurea, lentinan, lonidainine, maytansinoids, mitoguazone, mitoxantrone, mopidanmol, nitraerine, pentostatin, phenamet, pirarubicin, losoxantrone, podophyllinic acid, 2-ethylhydrazide, procarbazine, PSK® polysaccharide complex (JHS Natural Products, Eugene, Oreg.), razoxane; rhizoxin; sizofiran; spirogermanium; tenuazonic acid; triaziquone; 2,2',2"-trichlorotriethylamine; trichothecenes (especially T-2 toxin, verracurin A, roridin A and anguidine); urethan; vindesine; vemurafenib; dacarbazine; mannomustine; mitobronitol; mitolactol; pipobroman; gacytosine; arabinoside ("Ara-C"); cyclophosphamide; thiotepa; taxoids, chloranbucil; GEMZAR® gemcitabine; 6-thioguanine; mercaptopurine; methotrexate; platinum analogs, vinblastine; platinum; etoposide (VP-16); ifosfamide; mitoxantrone; vincristine; NAVELBINE® vinorelbine; novantrone; teniposide; edatrexate; daunomycin; aminopterin; xeloda; ibandronate; irinotecan (Camptosar, CPT-11), topoisomerase inhibitor RFS 2000; difluorometlhylornithine; retinoids; capecitabine; combretastatin; leucovorin; oxaliplatin; inhibitors of PKC-alpha, Raf, H-Ras, EGFR and VEGF-A that reduce cell proliferation and pharmaceutically acceptable salts or solvates, acids or derivatives of any of the above.

Also included, are anti-hormonal agents that act to regulate or inhibit hormone action on tumors such as anti-estrogens and selective estrogen receptor antibodies, aromatase inhibitors that inhibit the enzyme aromatase, which regulates estrogen production in the adrenal glands, and anti-androgens; as well as troxacitabine (a 1,3-dioxolane nucleoside cytosine analog); antisense oligonucleotides, ribozymes such as a VEGF expression inhibitor and a HER2 expression inhibitor; vaccines, PROLEUKIN® rIL-2; LURTOTECAN® topoisomerase 1 inhibitor; ABARELIX® rmRH; Vinorelbine and Esperamicins and pharmaceutically acceptable salts or solvates, acids or derivatives of any of the above.

Other compatible anti-cancer agents comprise commercially or clinically available compounds such as erlotinib (TARCEVA®, Genentech/OSI Pharm.), docetaxel (TAXOTERE®, Sanofi-Aventis), 5-FU (fluorouracil, 5-fluorouracil, CAS No. 51-21-8), PD-0325901 (CAS No. 391210-10-9, Pfizer), cisplatin (cis-diamine, dichloroplatinum(II), CAS No. 15663-27-1), carboplatin (CAS No. 41575-94-4), paclitaxel (TAXOL®, Bristol-Myers Squibb Oncology, Princeton, N.J.), trastuzumab (HERCEPTIN®, Genentech), temozolomide (4-methyl-5-oxo-2,3,4,6,8-pentazabicyclo [4.3.0] nona-2,7,9-triene-9-carboxamide, CAS No. 85622-93-1, TEMODAR®, TEMODAL®, Schering Plough), tamoxifen ((Z)-2-[4-(1,2-diphenylbut-1-enyl)phenoxy]-N,N-dimethylethanamine, NOLVADEX®, ISTUBAL®, VALODEX®), and doxorubicin (ADRIAMYCIN®). Additional commercially or clinically available anti-cancer agents comprise bortezomib (VELCADE®, Millennium Pharm.), sutent (SUNITINIB®, SU11248, Pfizer), letrozole (FEMARA®, Novartis), imatinib mesylate (GLEEVEC®, Novartis), XL-518 (Mek inhibitor, Exelixis, WO 2007/ 044515), ARRY-886 (Mek inhibitor, AZD6244, Array BioPharma, Astra Zeneca), SF-1126 (PI3K inhibitor, Semafore Pharmaceuticals), BEZ-235 (PI3K inhibitor, Novartis), XL-147 (PI3K inhibitor, Exelixis), PTK787/ZK 222584 (Novartis), fulvestrant (FASLODEX®, AstraZeneca), leucovorin (folinic acid), rapamycin (sirolimus, RAPAMUNE®, Wyeth), lapatinib (TYKERB®, GSK572016, Glaxo Smith Kline), lonafarnib (SARASAR™, SCH 66336, Schering Plough), sorafenib (NEXAVAR®, BAY43-9006, Bayer Labs), gefitinib (IRESSA®, AstraZeneca), irinotecan (CAMPTOSAR®, CPT-11, Pfizer), tipifarnib (ZARNESTRA™, Johnson & Johnson), ABRAXANE™ (Cremophor-free), albumin-engineered nanoparticle formulations of paclitaxel (American Pharmaceutical Partners, Schaumberg, Ill.), vandetanib (rINN, ZD6474, ZACTIMA®, AstraZeneca), chloranmbucil, AG1478, AG1571 (SU 5271; Sugen), temsirolimus (TORISEL®, Wyeth), pazopanib (Glaxo SmithKline), canfosfamide (TELCYTA®, Telik), thiotepa and cyclosphosphamide (CYTOXAN®, NEOSAR®); vinorelbine (NAVELBINE®); capecitabine (XELODA®, Roche), tamoxifen (including NOLVADEX®; tamoxifen citrate, FARESTON® (toremifene citrate) MEGASE® (megestrol acetate), AROMASIN® (exemestane; Pfizer), formestanie, fadrozole, RIVISOR® (vorozole), FEMARA® and ARIMIDEX® (anastrozole; AstraZeneca).); dabrafinib (TAFINLAR®, Glaxo SmithKline); dasatinib (SPRYCEL®, Bristol-Myers Squibb); trametinib (MEKINIST®, Glaxo SmithKline); nilotinib (TASIGNA®, Novartis).

The term "pharmaceutically acceptable salt" or "salt" means organic or inorganic salts of a molecule or macromolecule. Acid addition salts can be formed with amino groups. Exemplary salts include, but are not limited, to sulfate, citrate, acetate, oxalate, chloride, bromide, iodide, nitrate, bisulfate, phosphate, acid phosphate, isonicotinate, lactate, salicylate, acid citrate, tartrate, oleate, tannate, pantothenate, bitartrate, ascorbate, succinate, maleate, gentisinate, fumarate, gluconate, glucuronate, saccharate, formate, benzoate, glutamate, methanesulfonate, ethanesulfonate, benzenesulfonate, p-toluenesulfonate, and pamoate (i.e., 1,1' methylene bis-(2-hydroxy 3-naphthoate)) salts. A pharmaceutically acceptable salt may involve the inclusion of another molecule such as an acetate ion, a succinate ion or other counterion. The counterion may be any organic or inorganic moiety that stabilizes the charge on the parent compound. Furthermore, a pharmaceutically acceptable salt may have more than one charged atom in its structure. Where multiple charged atoms are part of the pharmaceutically acceptable salt, the salt can have multiple counter ions. Hence, a pharmaceutically acceptable salt can have one or more charged atoms and/or one or more counterion.

"Pharmaceutically acceptable solvate" or "solvate" refers to an association of one or more solvent molecules and a molecule or macromolecule. Examples of solvents that form pharmaceutically acceptable solvates include, but are not limited to, water, isopropanol, ethanol, methanol, DMSO, ethyl acetate, acetic acid, and ethanolamine.

In other embodiments the anti-DLL3 antibodies or ADCs of the instant invention may be used in combination with any one of a number of antibodies (or immunotherapeutic agents) presently in clinical trials or commercially available. The disclosed antibodies may be used in combination with an antibody selected from the group consisting of abagovomab, adecatumumab, afutuzumab, alemtuzumab, altumomab, amatuximab, anatumomab, arcitumomab, bavituximab, bectumomab, bevacizumab, bivatuzumab, blinatumomab, brentuximab, cantuzumab, catumaxomab, cetuximab, citatuzumab, cixutumumab, clivatuzumab, conatumumab, daratumumab, drozitumab, duligotumab, dusigitumab, detumomab, dacetuzumab, dalotuzumab, ecromeximab, elotuzumab, ensituximab, ertumaxomab, etaracizumab, farletuzumab, ficlatuzumab, figitumumab, flanvotumab, futuximab, ganitumab, gemtuzumab, girentuximab, glembatumumab, ibritumomab, igovomab, imgatuzumab, indatuximab, inotuzumab, intetumumab, ipilimumab, iratumumab, labetuzumab, lambrolizumab, lexatumumab, lintuzumab, lorvotuzumab, lucatumumab, mapatumumab, matuzumab, milatuzumab, minretumomab, mitumomab, moxetumomab, narnatumab, naptumomab, necitumumab, nimotuzumab, nivolumab, nofetumomabn, obinutuzumab, ocaratuzumab, ofatumumab, olaratumab, olaparib, onartuzumab, oportuzumab, oregovomab, panitumumab, parsatuzumab, patritumab, pemtumomab, pertuzumab, pidilizumab, pintumomab, pritumumab, racotumomab, radretumab, ramucirumab, rilotumumab, rituximab, robatumumab, satumomab, selumetinib, sibrotuzumab, siltuximab, simtuzumab, solitomab, tacatuzumab, taplitumomab, tenatumomab, teprotumumab, tigatuzumab, tositumomab, trastuzumab, tucotuzumab, ublituximab, veltuzumab, vorsetuzumab, votumumab, zalutumumab, CC49, 3F8, MDX-1105 and MEDI4736 and combinations thereof.

Other particularly preferred embodiments comprise the use of antibodies approved for cancer therapy including, but not limited to, rituximab, trastuzumab, gemtuzumab ozogamcin, alemtuzumab, ibritumomab tiuxetan, tositumomab, bevacizumab, cetuximab, patitumumab, ofatumumab, ipilimumab and brentuximab vedotin. Those skilled in the art will be able to readily identify additional anti-cancer agents that are compatible with the teachings herein.

III. Diagnostics, Prognostics and Surrogate Biomarkers

The invention provides in vitro and in vivo methods for diagnosing or monitoring melanoma, and determining prognosis of patients suffering from melanoma. In one embodiment the antibodies of the invention, optionally comprising a detectable label or reporter molecule, may be used to detect and quantify levels of a particular determinant (e.g., DLL3) in a patient sample which may, in turn, be used to diagnose, stage or monitor melanoma progression; or provide a prognostic marker for survival outcome for patients suffering from melanoma. In one embodiment the antibodies of the instant invention may be used to detect, monitor and/or quantify circulating tumor cells either in vivo or in vitro (WO 2012/0128801.) In still other embodiments the circulating tumor cells may comprise tumorigenic cells. In another embodiment, the invention comprises the use of surrogate biomarkers (as described below) to determine whether a patient suffering from melanoma expresses DLL3 and whether the tumor will be sensitive to treatment with an anti-DLL3 antibody or ADC disclosed herein. In yet another embodiment the expression of DLL3 can be used as a biomarker to assess the prognosis of a patient having melanoma. As will be appreciated DLL3 expression levels will generally be "determined" in a quantitative manner but in some instances, may also be determined qualitatively, for example in the case of determination of DLL3 expression levels using immunohistochemistry (See Example 14.)

1. Sources of Biomarkers

A fluid or tissue sample often is obtained from a subject for determining presence, absence or amount of biomarker ex vivo. Non-limiting parts of the body from which a tissue sample may be obtained include leg, arm, abdomen, upper back, lower back, chest, hand, finger, fingernail, foot, toe, toenail, neck, rectum, nose, throat, mouth, scalp, face, spine, throat, heart, lung, breast, kidney, liver, intestine, colon, pancreas, bladder, cervix, testes, muscle, skin, hair, region of inflammation, tumor, region of diffuse cancer cells, and the like, in some embodiments.

A tissue sample can be obtained by any suitable method known in the art, including, without limitation, biopsy (e.g., shave, punch, incisional, excisional, curettage, fine needle aspirate, scoop, scallop, core needle, vacuum assisted, open surgical biopsies) and the like, in certain embodiments. Examples of a fluid that can be obtained from a subject includes, without limitation, blood or any blood constituents, cerbrospinal fluid, spinal fluid, lavage fluid (e.g., bronchoalveolar, gastric, peritoneal, ductal, ear, athroscopic), urine, interstitial fluid, feces, sputum, saliva, nasal mucous, prostate fluid, lavage, semen, lymphatic fluid, bile, tears, sweat, breast milk, breast fluid, fluid from region of inflammation, fluid from a tumor region, a diffuse cell overgrowth region and the like, in some embodiments.

A sample from a subject may be processed prior to determining presence, absence or amount of a biomarker. For example, a blood sample from a subject may be processed to yield a certain fraction, including without limitation, plasma, serum, buffy coat, peripheral blood mononuclear cells (PBMC) and the like, and biomarker presence, absence or amount can be determined in the fraction. In certain embodiments, a tissue sample (e.g., tumor biopsy sample) can be processed by slicing the tissue sample and observing the sample under a microscope before and/or after the sliced sample is contacted with an agent that visualizes a biomarker (e.g., antibody). In some embodiments, a tissue sample can be exposed to one or more of the following non-limiting conditions: washing, exposure to high salt or low salt solution (e.g., hypertonic, hypotonic, isotonic solution), exposure to shearing conditions (e.g., sonication, press (e.g., French press)), mincing, centrifugation, separation of cells, separation of tissue and the like. In certain embodiments, a biomarker can be separated from tissue and the presence, absence or amount determined in vitro. A sample also may be stored for a period of time prior to determining the presence, absence or amount of a biomarker (e.g., a sample may be frozen, cryopreserved, maintained in a preservation medium (e.g., formaldehyde)).

2. Surrogate Biomarkers

In one embodiment certain genes can be used as surrogate biomarkers for the expression of DLL3. As will be appreciated expression surrogate biomarker levels will generally be "determined" in a quantitative manner but in some instances, may also be determined qualitatively, for example in the case of determination of gene expression levels using immunohistochemistry. As used herein, the term "surrogate biomarker" refers to a gene or protein whose expression is positively correlated or negatively correlated (anti-correlated) with the expression of the DLL3 gene or protein. The expression of the surrogate biomarker is determined as being positively correlated or anti-correlative with DLL3 expression using, for example, the Pearson correlation coefficient (a dimensionless index that ranges from −1.0 to 1.0.) A surrogate biomarker is positively correlated with DLL3 expression, if expression of the surrogate biomarker is indicative of expression of DLL3. "Positively correlated surrogate biomarkers" will have a Pearson correlation coefficient with DLL3 that is greater than 0.5, greater than 0.6, greater than 0.7, greater than 0.8, or greater than 0.9. Positively correlated surrogate biomarkers may include, but are not limited to, PUS7, EFHD1, PTP4A3, MYO1B, NFATC1, NUDT14, NR6A1, JAG2, HAUS5, ADAT3, PAFAH1B3, CCDC136, GAS5, PPFIA3, CDK8, ZNF114, KHSRP, MURC, ZNRD1, RPS19, LRRC43, ZCCHC3, LIN9, ZNF417, ATOH8, ATP6V1C1, RPS10, RPS19, BCL7A, CHRNB2, CAMKK1, SNORA43, TMEM117, CBLL1, HSPA12B, OR4C46, ZNF570, FANCF, ZNF480, TRPM6, CHD7 and combinations thereof. Thus, the invention discloses a method of treating melanoma in a subject comprising the steps of determining expression of one or more positively correlated surrogate biomarkers in a biological sample obtained from the patient, and if the one or more positively correlated surrogate biomarkers is expressed, treating the subject with a therapeutically effective amount of an anti-DLL3 antibody drug conjugate (ADC). This method may be performed with any surrogate biomarker that is positively correlated with DLL3, for example, the genes listed in FIG. 12A. It will be appreciated by one skilled in the art that in preferred embodiments, a combination of correlative markers can be used to indicate expression of DLL3.

In another embodiment the expression of the surrogate biomarkers of the invention may be anti-correlative with the expression of DLL3, meaning that low expression of the surrogate biomarker is indicative of expression of DLL3. "Anti-correlative surrogate biomarkers" will have a Pearson correlation coefficient with DLL3 of less than −0.5, less than −0.6, less than −0.7, less than −0.8, or less than −0.9. Anti-correlative surrogate biomarkers may include, but are not limited to, ZBTB20, GPR155, MST1, CLVS1, P4HA2, CIITA, ITPR2, BRK1, TGOLN2, TADA3, SLC38A11, KCNQ1, TMED6, NRXN3, SNX24, OLFML3, KCT2, PJA2, SEPT8 and combinations thereof. Thus, the invention discloses a method of treating melanoma in a subject comprising the steps of determining the expression of one or more anti-correlative surrogate biomarkers in a biological sample obtained from the patient, and if the one or more anti-correlative surrogate biomarkers is found to have low expression, treating the subject with a therapeutically effective amount of an anti-DLL3 antibody drug conjugate (ADC).

This method of treatment may be performed using any surrogate biomarker that is anti-correlative with DLL3, for example, the genes listed in FIG. 12B. It will be appreciated by one skilled in the art that in preferred embodiments, a combination of anti-correlative markers can be used to indicate expression of DLL3. In addition, a combination of correlative and anti-correlative markers can be used to indication DLL3 expression.

While any of the genes described above may be used as surrogate markers for DLL3, in preferred embodiments the surrogate biomarkers will be secreted surrogate biomarkers. As used herein, the term "secreted surrogate biomarker" means that the proteins expressed by the above biomarker genes will be secreted extracellularly and thus detectable in blood, plasma, and/or serum. Specifically, OLFML3 has been published to be secreted (Zeng L C et al 2004 FEBS Lett) and EFHD1 was inferred to be associated with extracellular vesicular exosomes (Prunotto M et al 2013 J Proteomics), and thus might be released into the extracellular region and detectable in serum.

Thus, in one embodiment, the invention comprises a method of treating melanoma in a subject comprising the steps of determining the expression of one or more secreted surrogate biomarkers in a biological sample obtained from the patient, for example, a blood sample, obtained from the patient, and treating the subject with a therapeutically effective amount of an anti-DLL3 antibody drug conjugate.

In another embodiment, the invention comprises a method of treating melanoma in a subject comprising the steps of determining the expression of EFHD in a biological sample obtained from the patient, including a blood sample, obtained from the patient, and if EFHD is found to be expressed, treating the subject with a therapeutically effective amount of an anti-DLL3 antibody drug conjugate.

In a further embodiment the invention contemplates a method of treating melanoma in a subject comprising the steps of determining expression of OLFML3 in a biological sample obtained from the patient, including a blood sample, obtained from the patient, and if OLFML3 is found to be expressed, treating the subject with a therapeutically effective amount of an anti-DLL3 antibody drug conjugate.

The term "determine the expression" or "determining expression", or any corollary thereof, as used herein means measuring the presence, absence, or level of some physical, chemical, or genetic characteristic of the relevant gene (e.g. DLL3 or a surrogate biomarker) or its expression product(s). For example, determining expression of DLL3 may be accomplished by assessing the levels of RNA transcripts for DLL3 or a surrogate biomarker for DLL3. Suitable methods for determining expression of RNA levels include, but are not limited to, RT-PCR (e.g. qRT-PCR), Northern Blot, in situ hybridization, Southern Blot, slot-blotting, nuclease protection assay, and nucleic acid arrays (e.g. microarray). RNA in situ hybridization is another method of detecting RNA expression. It can be performed, for example, using an RNAscope® 2.0 Reagent Kit (Advanced Cell Diagnostics; Wang et al, 2012, PMID: 22166544). The RNAscope probe can be designed specifically for each surrogate biomarker or for DLL3. Alternatively, determining expression of DLL3 may be accomplished by assessing the presence, absence or level of protein encoded by DLL3 or the surrogate biomarkers. Suitable methods include, but are not limited to, immunoassays such as radioimmunoassays, ELISA, RIA, flow cytometry or fluorescence-activated cell sorting (FACS), or Western Blot. In some embodiments, an ELISA assay is used to determine the expression of DLL3 and/or a surrogate biomarker in serum from subjects bearing tumors (e.g.

MEL) and comparing such expression in a subject not bearing tumors. Methods based on 2-dimensional SDS-polyacrylamide gel electrophoresis can also be used. Immunohistochemistry may also be used, for example, as described in Example 14, using the antibodies disclosed in the current application and antibodies that compete with such antibodies (e.g. sc16.65; SEQ ID NO.: 173 and SEQ ID NO.: 175.)

In some embodiments, the determination of whether DLL3 or the surrogate biomarker is expressed and at what level (e.g. high or low expression) is made by comparing the expression level of DLL3 or the surrogate biomarker to an index value. The term "high expression" as used herein, means that one or more of the above characteristics for determining expression of DLL3 (e.g., protein or mRNA level) is higher than an index value for that characteristic. Conversely "low expression" means that one or more of the above characteristics (e.g., protein or mRNA level) is lower than an index value for that characteristic. In this context, "low expression" generally includes instances in which the characteristic is absent or undetectable. For example, DLL3 has low expression if DLL3 nucleic acid and/or protein is absent or undetectable in a sample.

Those skilled in the art will appreciate how to obtain and use an index value in the methods of the invention. The index value and the method of obtaining such index value will vary based on the method of determining expression of DLL3 or the surrogate biomarker. In some embodiments, the index value may represent the DLL3 gene expression levels found in a normal (i.e., non-diseased) sample obtained from a patient, or in a sampling of healthy (e.g. non-melanoma patient) individuals, in which case an expression level in the tumor sample above this index value would indicate the suitability of a treatment using anti-DLL3 ADCs (e.g., See FIG. 2).

In still other embodiments of this invention, the amount of an expression product of DLL3 or a surrogate biomarker may be normalized against the amount of expression of a normalizing gene (e.g., one or more housekeeping genes) to generate an index value that simply helps in reducing background noise when determining the expression level of the gene of interest. In one embodiment, for example, in determining the level of expression of a relevant gene in accordance with the present invention, the amount of an expression product of the gene (e.g., mRNA, cDNA, protein) is measured within one or more cells, particularly tumor cells, and normalized against the amount of the expression product(s) of a normalizing gene, or a set of normalizing genes, within the same one or more cells, to obtain the level of expression of the relevant marker gene. For example, when a single gene is used as a normalizing gene, a housekeeping gene, whose expression is determined to be independent of melanoma outcome/prognosis or not to vary between normal and melanoma cells, can be used (e.g., FIG. 3). A set of such housekeeping genes can also be used in gene expression analysis to provide a combined normalizing gene set. Housekeeping genes are well known in the art, with examples including, but are not limited to, ALAS1, ACTB, GUSB (glucuronidase, beta), HMBS (hydroxymethylbilane synthase), SDHA (succinate dehydrogenase complex, subunit A, flavoprotein), UBC (ubiquitin C) and YWHAZ (tyrosine 3-monooxygenase/tryptophan 5-monooxygenase activation protein, zeta polypeptide). When a combined normalizing gene set is used in the normalization, the amount of gene expression of such normalizing genes can be averaged, combined together by straight additions or by a defined algorithm. Genes other than housekeeping genes may also be used as normalizing genes.

The presence or high expression of positively correlated surrogate biomarkers with DLL3 expression is predictive of whether the tumor will be sensitive to treatment with an anti-DLL3 antibody or ADC. Likewise, the absence or low expression of anti-correlative surrogate biomarkers with DLL3 expression is predictive of whether the tumor will be sensitive to treatment with an anti-DLL3 antibody or ADC.

3. Prognostic Biomarkers of Melanoma

Melanoma patients with similar clinical and pathological characteristics can vary dramatically in their survival and response to treatment. Much of this variation is associated with differences in the molecular and cellular architecture of their tumors, which has been found to influence the development, invasiveness or metastasis of melanoma (Bertolotto, 2013, PMID: 24416617.) These findings suggest that treatment decisions can be optimized based on molecular features of each individual's tumor. Microarray and high-throughput sequencing technologies can profile the relative abundance of thousands of genes in a tumor, thereby providing a comprehensive snapshot of tumor state. The prognostic value of DLL3 gene expression can be determined by analyzing data from large scale, comprehensive, multi-node programs like International Cancer Genomic consortium (ICGC) (http://icgc.org/webcite) and The Cancer Genome Atlas (TCGA) (http://cancergenome.nih.gov/webcite), which house data from large collections of patient tumors and enable systematic studies on genomic, epigenomic and transcriptomic levels for different cancer types (e.g. MEL). The inventors have determined that DLL3 can be used as a molecular prognostic marker of disease progression in melanoma based on data obtain from the TCGA database; melanoma patients having expression of DLL3 above a threshold index value have been found to have a poor prognosis (See Example 4.) As will be appreciated DLL3 expression levels will generally be "determined" in a quantitative manner but in some instances, may also be determined qualitatively, for example in the case of determination of DLL3 expression levels using immunohistochemistry (See Example 14.)

In the context of the invention, "expression above a threshold index value" means a gene expression level that is higher than a "threshold index value" and "expression below a threshold index value" means a gene expression level that is lower than a "threshold index value". Those skilled in the art will appreciate how to obtain and use a threshold index value in the methods of the invention. The threshold index value and the method of obtaining such threshold index value will vary based on the method of determining gene expression levels. In one embodiment, a threshold index value can be determined, for example, as the average expression level of DLL3 in a set of individuals from a random sampling of patients with melanoma, wherein patients having DLL3 expression higher than this threshold index value are expected to have a poor prognosis compared to those having expression lower than the threshold index value. This average expression level may be an arithmetic average (i.e., the "mean"), geometric mean, or harmonic mean of the set, depending upon the nature of the technique employed and the measurements obtained. In another embodiment, where there is bimodal distribution of expression data, the threshold index value will fall between the peaks of the data set. Example 4, demonstrates a method of determining a threshold index value determined and validated experimentally.

The threshold index value will differ based on the methods used to determine DLL3 expression. In one embodiment, DLL3 expression can be determined in a tumor sample, by performing RNA sequencing using the IlluminaHiSeq_RNASeqV2 platform and parsing the aggregate reads from the individual exons of each gene to generate a single value RPKM (reads per kilobase of transcript per million mapped reads in RNA-Seq.) In this case, the threshold index value can be determined as the arithmetic mean RPKM value and the patients can be stratified based on whether their RPKM values are above or below the arithmetic mean or threshold index value. FIG. 4B shows Kaplan Meier survival curves for patient survival based on the subset of the MEL tumors from the TCGA database where clinical survival data was available with that patient tumor sample. Two separate survival probability curves are shown: one for patients with DLL3 mRNA expression above the arithmetic mean RPKM value and one for patients with DLL3 mRNA expression below the mean arithmetic RPKM value. These data show that DLL3 mRNA expression is related to patient survival and that patients with DLL3 mRNA expression above the threshold index value survive for a shorter time after cancer diagnosis compared to patients below the threshold index value. This difference is statistically significant with a p-value of 0.0019. In some embodiments, the threshold index value determined using RNA-Seq will be an RPKM of 17. In other embodiments, the threshold index value will be a lower value (e.g. 16, 15, 14, 13, 12, 11, 10, 9, 8, 7, 6, 5, 4, 3, 2 or 1.)

Thus, in one embodiment, the invention discloses a method of assessing the prognosis of a patient having melanoma comprising the steps determining the expression of DLL3 in a biological sample from the patient, and if such sample has DLL3 expression above a threshold index value, assessing that the patient has a poor prognosis.

Alternatively, DLL3 expression can be determined with immunohistochemistry using anti-DLL3 antibodies, including for example, SC16.65 or antibodies that compete for binding to human DLL3 with SC16.65. Immunohistochemistry can be performed on tumor tissue sections that are formalin fixed and paraffin embedded. Membrane expression can be analyzed with an automated image analysis software package (e.g., Leica Biosystems) that quantifies the intensity of cell surface staining and provides a final "H-Score", which reflects the percentage of tumor cells stained at each intensity level (0 for no staining and 3 for intense staining). The H-Score can be calculated as follows: (% at 0)*0+(% at 1+)*1+(% at 2+)*2+(% at 3+)*3. Thus, the H-Score produces a continuous variable that ranges from 0 to 300. In such case, the threshold index value can be determined based on the mean H-Score derived from analysis of IHC staining of tumors obtained from a population of melanoma patients. In one aspect, where DLL3 expression is determined by immunohistochemistry, the threshold index value will be greater than an H-Score of e,g., 70, 80, 90, 100, 120, 140, 160, 180, 200, 220, 240, 260, 280 and up to 300. Where staining is assessed qualitatively, a threshold index value can be defined as a staining intensity that is an average value based on a comparison of expression between the various melanoma tumor samples in a population.

Thus, in a further embodiment, the invention discloses a method of assessing the prognosis of a patient having melanoma comprising the steps of determining the expression of DLL3 in a biological sample from the patient using immunohistochemistry with an anti-DLL3 antibody. In one aspect of the invention, the anti-DLL3 antibody comprises a light chain variable region set forth as SEQ ID NO: 173 and a heavy chain variable region set forth as SEQ ID NO: 175 or an antibody that competes with such antibody, and if such sample has expression of DLL3 above a threshold index, determining that the patient has a poor prognosis.

In another aspect, DLL3 expression can be determined by qPCR (e.g. qRT-PCR) and the threshold index value may be determined as the arithmetic average (i.e., the "mean"), geometric mean, or harmonic mean expression value of DLL3 from a set of melanoma tumor samples. In yet another embodiment, DLL3 expression can be determined using microarray and the threshold index value can be determined as the arithmetic average (i.e., the "mean"), geometric mean, or harmonic mean normalized intensity value of DLL3 expression from a set of melanoma tumor samples.

Additionally, the inventors have found that DLL3 expression above a threshold index value has been found to be a biomarker of poor prognosis in melanoma in patients having early stage melanoma, e.g., Stage II and Stage III (See Example 4 and FIGS. 4B and 4C.) In one embodiment, the invention discloses a method of assessing the prognosis of a patient having melanoma comprising the steps of determining the expression of DLL3 in a biological sample from the patient, and if such sample has high expression of DLL3 compared to the expression of DLL3 in other patient melanoma samples, determining that the patient has a poor prognosis.

A method of treating a subject having Stage II melanoma comprising the steps of diagnosing Stage II melanoma in a subject, determining the expression of DLL3 in a biological sample from the patient, and if such sample has DLL3 expression above a threshold index value, treating the subject with a therapeutically effective amount of an anti-DLL3 antibody drug conjugate.

IV. Pharmaceutical Preparations

1. Formulations and Routes of Administration

Anti-DLL3 antibodies or ADCs can be formulated in various ways using art recognized techniques. In some embodiments, the therapeutic compositions of the invention can be administered neat or with a minimum of additional components while others may optionally be formulated to contain suitable pharmaceutically acceptable carriers. As used herein, "pharmaceutically acceptable carriers" comprise excipients, vehicles, adjuvants and diluents that are well known in the art and can be available from commercial sources for use in pharmaceutical preparation (see, e.g., Gennaro (2003) *Remington: The Science and Practice of Pharmacy with Facts and Comparisons: Drugfacts Plus*, 20th ed., Mack Publishing; Ansel et al. (2004) *Pharmaceutical Dosage Forms and Drug Delivery Systems*, 7$^{th}$ ed., Lippencott Williams and Wilkins; Kibbe et al. (2000) *Handbook of Pharmaceutical Excipients*, 3$^{rd}$ ed., Pharmaceutical Press.)

Suitable pharmaceutically acceptable carriers comprise substances that are relatively inert and can facilitate administration of the antibody or can aid processing of the active compounds into preparations that are pharmaceutically optimized for delivery to the site of action.

Such pharmaceutically acceptable carriers include agents that can alter the form, consistency, viscosity, pH, tonicity, stability, osmolarity, pharmacokinetics, protein aggregation or solubility of the formulation and include buffering agents, wetting agents, emulsifying agents, diluents, encapsulating agents and skin penetration enhancers. Certain non-limiting examples of carriers include saline, buffered saline, dextrose, arginine, sucrose, water, glycerol, ethanol, sorbitol, dextran, sodium carboxymethyl cellulose and combinations thereof. Disclosed antibodies for systemic administration may be formulated for enteral, parenteral or topical administration. Indeed, all three types of formulation may be used simultaneously to achieve systemic administration of the active ingredient. Excipients as well as formulations for parenteral and nonparenteral drug delivery are set forth in *Remington: The Science and Practice of Pharmacy* (2000) 20th Ed. Mack Publishing. Suitable formulations for parenteral administration of the antibodies include aqueous solutions or suspensions. Suitable lipophilic solvents or vehicles include fatty oils, for example, sesame oil, or synthetic fatty acid esters, for example, ethyl oleate or triglycerides. Liposomes can also be used to encapsulate the agent for delivery into the cell.

Suitable formulations for enteral administration include hard or soft gelatin capsules, pills, tablets, including coated tablets, elixirs, suspensions, syrups or inhalations and controlled release forms thereof. Formulations suitable for parenteral administration (e.g., by injection), include aqueous or non-aqueous, isotonic, pyrogen-free, sterile liquids (e.g., solutions, suspensions), in which the active ingredient is dissolved, suspended, or otherwise provided (e.g., in a liposome or other microparticulate). Such liquids may additional contain other pharmaceutically acceptable ingredients, such as anti-oxidants, buffers, preservatives, stabilisers, bacteriostats, suspending agents, thickening agents, and solutes which render the formulation isotonic with the blood (or other relevant bodily fluid) of the intended recipient. Examples of excipients include, for example, water, alcohols, polyols, glycerol, vegetable oils, and the like. Examples of suitable isotonic carriers for use in such formulations include Sodium Chloride Injection, Ringer's Solution, or Lactated Ringer's Injection.

Compatible formulations for parenteral administration (e.g., intravenous injection) will comprise ADC or antibody concentrations of from about 10 µg/ml to about 100 mg/ml. In certain selected embodiments antibody or ADC concentrations will comprise 20 µg/ml, 40 µg/ml, 60 µg/ml, 80 µg/ml, 100 µg/ml, 200 µg/ml, 300, µg/ml, 400 µg/ml, 500 µg/ml, 600 µg/ml, 700 µg/ml, 800 µg/ml, 900 µg/ml or 1 mg/ml. In other preferred embodiments ADC concentrations will comprise 2 mg/ml, 3 mg/ml, 4 mg/ml, 5 mg/ml, 6 mg/ml, 8 mg/ml, 10 mg/ml, 12 mg/ml, 14 mg/ml, 16 mg/ml, 18 mg/ml, 20 mg/ml, 25 mg/ml, 30 mg/ml, 35 mg/ml, 40 mg/ml, 45 mg/ml, 50 mg/ml, 60 mg/ml, 70 mg/ml, 80 mg/ml, 90 mg/ml or 100 mg/ml.

The compounds and compositions of the invention may be administered in vivo, to a subject in need thereof, by various routes, including, but not limited to, oral, intravenous, intra-arterial, subcutaneous, parenteral, intranasal, intramuscular, intracardiac, intraventricular, intratracheal, buccal, rectal, intraperitoneal, intradermal, topical, transdermal, and intrathecal, or otherwise by implantation or inhalation. The subject compositions may be formulated into preparations in solid, semi-solid, liquid, or gaseous forms; including, but not limited to, tablets, capsules, powders, granules, ointments, solutions, suppositories, enemas, injections, inhalants, and aerosols. The appropriate formulation and route of administration may be selected according to the intended application and therapeutic regimen.

2. Dosages

The particular dosage regimen, i.e., dose, timing and repetition, will depend on the particular subject, as well as empirical considerations such as pharmacokinetics (e.g., half-life, clearance rate, etc.). Determination of the frequency of administration may be made by persons skilled in the art, such as an attending physician based on considerations of the condition and severity of the condition being treated, age and general state of health of the subject being treated and the like. Frequency of administration may be adjusted over the course of therapy based on assessment of the efficacy of the selected composition and the dosing regimen. Such assessment can be made on the basis of markers of the specific disease, disorder or condition. In embodiments where the individual has cancer, these include direct measurements of tumor size via palpation or visual observation; indirect measurement of tumor size by x-ray or other imaging techniques; an improvement as assessed by direct tumor biopsy and microscopic examination of a tumor sample; the measurement of a surrogate biomarker (e.g., BRAF) or an antigen identified according to the methods described herein; reduction in the number of proliferative or tumorigenic cells, maintenance of the reduction of such neoplastic cells; reduction of the proliferation of neoplastic cells; or delay in the development of metastasis.

In general, the DLL3 antibodies or ADCs of the invention may be administered in various ranges. These include about 5 µg/kg body weight to about 100 mg/kg body weight per dose; about 50 µg/kg body weight to about 5 mg/kg body weight per dose; about 100 µg/kg body weight to about 10 mg/kg body weight per dose. Other ranges include about 100 µg/kg body weight to about 20 mg/kg body weight per dose and about 0.5 mg/kg body weight to about 20 mg/kg body weight per dose. In certain embodiments, the dosage is at least about 100 µg/kg body weight, at least about 250 µg/kg body weight, at least about 750 µg/kg body weight, at least about 3 mg/kg body weight, at least about 5 mg/kg body weight, at least about 10 mg/kg body weight.

In selected embodiments the DLL3 antibodies or ADCs will be administered (preferably intravenously) at approximately 10, 20, 30, 40, 50, 60, 70, 80, 90 or 100 µg/kg body weight per dose. Other embodiments will comprise the administration of ADCs at about 200, 300, 400, 500, 600, 700, 800, 900, 1000, 1100, 1200, 1300, 1400, 1500, 1600, 1700, 1800, 1900 or 2000 µg/kg body weight per dose. In other preferred embodiments the disclosed conjugates will be administered at 2.5, 3, 3.5, 4, 4.5, 5, 5.5, 6, 6.5, 7, 7.58, 9 or 10 mg/kg. In still other embodiments the conjugates may be administered at 12, 14, 16, 18 or 20 mg/kg body weight per dose. In yet other embodiments the conjugates may be administered at 25, 30, 35, 40, 45, 50, 55, 60, 65, 70, 75, 80, 90 or 100 mg/kg body weight per dose. With the teachings herein one of skill in the art could readily determine appropriate dosages for various DLL3 antibodies or ADCs based on preclinical animal studies, clinical observations and standard medical and biochemical techniques and measurements.

An effective dose of the composition of the invention can be administered to a subject in various concentration ranges one or more times; once a month, more than once a month, or less than once a month. Individuals can also be given incremental dosages of the therapeutic composition.

In some embodiments, the anti-DLL3 antibodies or ADCs will be administered on a regular schedule over a period of time, such as once, twice or three times daily, once every two days, once every three days, once weekly, once every two weeks, monthly, every six weeks, every two months, every three months every six months or annually. Such treatments could be continued for a period of weeks, months, years or even indefinitely depending on the patient response and clinical and diagnostic parameters.

V. Cancer Stem Cells

According to the current models, a tumor comprises non-tumorigenic cells and tumorigenic cells. Non-tumorigenic cells do not have the capacity to self-renew and are incapable of reproducibly forming tumors, even when transplanted into immunocompromised mice in excess cell numbers. Tumorigenic cells, also referred to herein as "tumor initiating cells" (TICs), which make up 0.1-95% of a melanoma tumor's cell population, have the ability to form tumors. Tumorigenic cells encompass both cancer stem cells (CSCs) and tumor progenitor cells (TProgs).

CSCs, like normal stem cells that support cellular hierarchies in normal tissue, are able to self-replicate indefinitely while maintaining the capacity for multilineage differentiation. CSCs are able to generate both tumorigenic progeny and non-tumorigenic progeny and are able to completely recapitulate the heterogeneous cellular composition of the parental tumor as demonstrated by serial isolation and transplantation of low numbers of isolated CSCs into immunocompromised mice.

TProgs, like CSCs have the ability to fuel tumor growth in a primary transplant. However, unlike CSCs, they are not able to recapitulate the cellular heterogeneity of the parental tumor and are less efficient at reinitiating tumorigenesis in subsequent transplants because TProgs are typically only capable of a finite number of cell divisions as demonstrated by serial transplantation of low numbers of highly purified TProg into immunocompromised mice. CSCs exhibit higher tumorigenicity and are relatively more quiescent than TProgs and non-tumorigenic cells such as tumor-infiltrating cells, for example, fibroblasts/stroma, endothelial and hematopoietic cells typically comprise the bulk of a tumor. Given that conventional therapies and regimens have, in large part, been designed to debulk tumors and attack rapidly proliferating cells, CSCs are more resistant to conventional therapies and regimens than the faster proliferating non-tumorigenic cells. Other characteristics that may make CSCs relatively chemoresistant to conventional therapies are increased expression of multi-drug resistance transporters, enhanced DNA repair mechanisms and anti-apoptotic gene expression. These properties in CSCs constitute a key reason for the failure of standard oncology treatment regimens to ensure long-term benefit for most patients with advanced stage neoplasia because standard chemotherapy does not target the CSCs that actually fuel continued tumor growth and recurrence.

DLL3 expression was shown to be associated with various tumorigenic cell subpopulations (U.S.P.N. PCT/US13/27391) and therefore the anti-DLL3 ADCs disclosed herein may be useful in treating melanoma by inhibiting or reducing the frequency of CSCs. Methods that can be used to assess the reduction in the frequency of tumorigenic cells, include but are not limited to in vitro or in vivo limiting dilution analysis (Dylla et al. 2008, PMID: PMC2413402 and Hoey et al. 2009, PMID: 19664991.) Flow cytometry and immunohistochemistry may also be used to determine tumorigenic cell frequency. Both techniques employ one or more antibodies or reagents that bind art recognized cell surface proteins or markers known to enrich for tumorigenic cells (see WO 2012/031280). As known in the art, flow cytometry (e.g. FACS) can also be used to characterize, isolate, purify, enrich or sort for various cell populations including tumorigenic cells. Flow cytometry measures tumorigenic cell levels by passing a stream of fluid, in which a mixed population of cells is suspended, through an electronic detection apparatus which is able to measure the physical and/or chemical characteristics of up to thousands of particles per second. Immunohistochemistry provides additional information in that it enables visualization of tumorigenic cells in situ (e.g., in a tissue section) by staining the tissue sample with labeled antibodies or reagents which bind to tumorigenic cell markers. FACS is a reliable method used to isolate cell subpopulations at more than 99.5% purity based on specific cell surface markers.

The antibodies of the invention may be useful for identifying, characterizing, monitoring, isolating, sectioning or enriching populations or subpopulations of tumorigenic cells through methods such as, for example, flow cytometry, magnetic activated cell sorting (MACS), laser mediated sectioning or FACS. Other compatible techniques for the characterization and manipulation of tumorigenic cells including CSCs can be seen, for example, in U.S. patent Ser. Nos. 12/686,359, 12/669,136 and 12/757,649.

Listed below are markers that have been associated with CSC populations and have been used to isolate or characterize CSCs: ABCA1, ABCA3, ABCG2, ADAM9, ADCY9, ADORA2A, AFP, AXIN1, B7H3, BCL9, Bmi-1, BMP-4, C20orf52, C4.4A, carboxypeptidase M, CAV1, CAV2, CD105, CD133, CD14, CD16, CD166, CD16a, CD16b, CD2, CD20, CD24, CD29, CD3, CD31, CD324, CD325, CD34, CD38, CD44, CD45, CD46, CD49b, CD49f, CD56, CD64, CD74, CD9, CD90, CD271, CEACAM6, CELSR1, CPD, CRIM1, CX3CL1, CXCR4, DAF, decorin, easyh1, easyh2, EDG3, eed, EGFR, ENPP1, EPCAM, EPHA1, EPHA2, FLJ10052, FLVCR, FZD1, FZD10, FZD2, FZD3, FZD4, FZD6, FZD7, FZD8, FZD9, GD2, GJA1, GLI1, GLI2, GPNMB, GPR54, GPRCSB, IL1R1, IL1RAP, JAM3, Lgr5, Lgr6, LRP3, LY6E, MCP, mf2, mllt3, MPZL1, MUC1, MUC16, MYC, N33, Nanog, NB84, nestin, NID2, NMA, NPC1, oncostatin M, OCT4, OPN3, PCDH7, PCDHA10, PCDHB2, PPAP2C, PTPN3, PTS, RARRES1, SEMA4B, SLC19A2, SLC1A1, SLC39A1, SLC4A11, SLC6A14, SLC7A8, smarcA3, smarcD3, smarcE1, smarckA5, Sox1, STAT3, STEAP, TCF4, TEM8, TGFBR3, TMEPAI, TMPRSS4, transferrin receptor, TrkA, WNT10B, WNT16, WNT2, WNT2B, WNT3, WNT5A, YY1 and β-catenin. See, for example, Schulenburg et al., 2010, PMID: 20185329, U.S. Pat. No. 7,632,678 and U.S.P.N.s. 2007/0292414, 2008/0175870, 2010/0275280, 2010/0162416 and 2011/0020221.

Similarly, non-limiting examples of cell surface phenotypes associated with CSCs of certain tumor types include $CD44^{hi}CD24^{low}$, $ALDH^+$, $CD133^+$, $CD123^+$, $CD34^+CD38^-$, $CD44^+CD24^-$, $CD46^{hi}CD324^+CD66c^-$, $CD133^+CD34^+CD10^-CD19^-$, $CD138^-CD34^-CD19^+$, $CD133^+RC2^+$, $CD44^+\alpha_2\beta_1^{hi}CD133^+$, $CD44^+CD24^+ESA^+$, $CD271^+$, $ABCB5^+$ as well as other CSC surface phenotypes that are known in the art. See, for example, Schulenburg et al., 2010, supra, Visvader et al., 2008, PMID: 18784658 and U.S.P.N. 2008/0138313.

The ability of the antibodies of the current invention to reduce the frequency of tumorigenic cells can therefore be determined using the techniques and markers described above. In some instances, the anti-DLL3 antibodies may reduce the frequency of tumorigenic cells by 10%, 15%, 20%, 25%, 30% or even by 35%. In other embodiments, the reduction in frequency of tumorigenic cells may be in the order of 40%, 45%, 50%, 55%, 60% or 65%. In certain embodiments, the disclosed compounds my reduce the frequency of tumorigenic cells by 70%, 75%, 80%, 85%, 90% or even 95%. Any reduction of the frequency of tumorigenic cells is likely to result in a corresponding reduction in the tumorigenicity, persistence, recurrence and aggressiveness of the neoplasia.

VI. Antibodies

1. Antibody Structure

Antibodies and variants and derivatives thereof, including accepted nomenclature and numbering systems, have been extensively described, for example, in Abbas et al. (2010),

*Cellular and Molecular Immunology* (6th Ed.), W.B. Saunders Company; or Murphey et al. (2011), *Janeway's Immunobiology* (8th Ed.), Garland Science.

An "antibody" or "intact antibody" typically refers to a Y-shaped tetrameric protein comprising two heavy (H) and two light (L) polypeptide chains held together by covalent disulfide bonds and non-covalent interactions. Human light chains are classified as kappa or lambda light chains. Each light chain is composed of one variable domain (VL) and one constant domain ($C_L$). Each heavy chain comprises one variable domain (VH) and a constant region, which in the case of IgG, IgA, and IgD, comprises three domains termed $C_H1$, $C_H2$, and $C_H3$ (IgM and IgE have a fourth domain, $C_H4$). In IgG, IgA, and IgD classes the $C_H1$ and $C_H2$ domains are separated by a flexible hinge region, which is a proline and cysteine rich segment of variable length (generally from about 10 to about 60 amino acids in IgG). The variable domains in both the light and heavy chains are joined to the constant domains by a "J" region of about 12 or more amino acids and the heavy chain also has a "D" region of about 10 additional amino acids. Each class of antibody further comprises inter-chain and intra-chain disulfide bonds formed by paired cysteine residues.

As used herein the term "antibody" includes polyclonal antibodies, multiclonal antibodies, monoclonal antibodies, chimeric antibodies, humanized and primatized antibodies, CDR grafted antibodies, human antibodies, recombinantly produced antibodies, intrabodies, multispecific antibodies, bispecific antibodies, monovalent antibodies, multivalent antibodies, anti-idiotypic antibodies, synthetic antibodies, including muteins and variants thereof, immunospecific antibody fragments such as Fd, Fab, F(ab')$_2$, F(ab') fragments, single-chain fragments (e.g. ScFv and ScFvFc); and derivatives thereof including Fc fusions and other modifications, and any other immunoreactive molecule so long as it exhibits preferential association or binding with a determinant.

The variable domains of antibodies show considerable variation in amino acid composition from one antibody to another and are primarily responsible for antigen recognition. Variable regions of each light/heavy chain pair form the antibody binding site such that an intact IgG antibody has two binding sites (i.e. it is bivalent). VH and VL domains comprise three regions of extreme variability, which are termed hypervariable regions, or more commonly, complementarity-determining regions (CDRs), separated by less variable regions called framework regions (FRs). The non-covalent association between the VH and the VL region forms the Fv fragment (for "fragment variable") which contains one of the two antigen-binding sites of the antibody. ScFv fragments (for single chain fragment variable), which can be obtained by genetic engineering, associates in a single polypeptide chain, the VH and the VL region of an antibody, separated by a peptide linker.

As used herein, the assignment of amino acids to each domain, framework region and CDR may be in accordance with one of the numbering schemes provided by Kabat et al. (1991) *Sequences of Proteins of Immunological Interest* (5th Ed.), US Dept. of Health and Human Services, PHS, NIH, NIH Publication no. 91-3242; Chothia et al., 1987, PMID: 3681981; Chothia et al., 1989, PMID: 2687698; MacCallum et al., 1996, PMID: 8876650; or Dubel, Ed. (2007) *Handbook of Therapeutic Antibodies*, 3rd Ed., Wily-VCH Verlag GmbH and Co. unless otherwise noted. The amino acid residues which comprise CDRs as defined by Kabat, Chothia and MacCallum as obtained from the Abysis website database (infra.) are set out in TABLE 1 below.

TABLE 1

|         | Kabat  | Chothia | MacCallum |
|---------|--------|---------|-----------|
| VH CDR1 | 31-35  | 26-32   | 30-35     |
| VH CDR2 | 50-65  | 52-56   | 47-58     |
| VH CDR3 | 95-102 | 95-102  | 93-101    |
| VL CDR1 | 24-34  | 24-34   | 30-36     |
| VL CDR2 | 50-56  | 50-56   | 46-55     |
| VL CDR3 | 89-97  | 89-97   | 89-96     |

Variable regions and CDRs in an antibody sequence can be identified according to general rules that have been developed in the art (as set out above, such as, for example, the Kabat numbering system) or by aligning the sequences against a database of known variable regions. Methods for identifying these regions are described in Kontermann and Dubel, eds., Antibody Engineering, Springer, New York, N.Y., 2001 and Dinarello et al., Current Protocols in Immunology, John Wiley and Sons Inc., Hoboken, N.J., 2000. Exemplary databases of antibody sequences are described in, and can be accessed through, the "Abysis" website at www.bioinf.org.uk/abs (maintained by A. C. Martin in the Department of Biochemistry & Molecular Biology University College London, London, England) and the VBASE2 website at www.vbase2.org, as described in Retter et al., Nucl. Acids Res., 33 (Database issue): D671-D674 (2005). Preferably the sequences are analyzed using the Abysis database, which integrates sequence data from Kabat, IMGT and the Protein Data Bank (PDB) with structural data from the PDB. See Dr. Andrew C. R. Martin's book chapter *Protein Sequence and Structure Analysis of Antibody Variable Domains*. In: *Antibody Engineering Lab Manual* (Ed.: Duebel, S. and Kontermann, R., Springer-Verlag, Heidelberg, ISBN-13: 978-3540413547, also available on the website bioinforg.uk/abs). The Abysis database website further includes general rules that have been developed for identifying CDRs which can be used in accordance with the teachings herein. Unless otherwise indicated, all CDRs set forth herein are derived according to the Abysis database website as per Kabat.

For heavy chain constant region amino acid positions discussed in the invention, numbering is according to the Eu index first described in Edelman et al., 1969, Proc, Natl. Acad. Sci. USA 63(1): 78-85 describing the amino acid sequence of myeloma protein Eu, which reportedly was the first human IgG1 sequenced. The Eu index of Edelman is also set forth in Kabat et al., 1991 (supra.). Thus, the terms "EU index as set forth in Kabat" or "EU index of Kabat" in the context of the heavy chain refers to the residue numbering system based on the human IgG1 Eu antibody of Edelman et al. as set forth in Kabat et al., 1991 (supra.). The numbering system used for the light chain constant region amino acid sequence is similarly set forth in Kabat et al., 1991. Exemplary kappa $C_L$ and IgG1 heavy chain constant region amino acid sequences compatible with the instant invention are set forth as SEQ ID NOS: 5 and 6 in the appended sequence listing. The disclosed constant region sequences may be joined with the disclosed heavy and light chain variable regions using standard molecular biology techniques to provide full-length antibodies that may be used as such or incorporated in the anti-DLL3 ADCs of the instant invention.

The antibodies or immunoglobulins of the invention may be generated from an antibody that specifically recognizes or associates with any relevant determinant. As used herein "determinant" or "target" means any detectable trait, property, biomarker or factor that is identifiably associated with, or specifically found in or on a particular cell, cell population or tissue. Determinants or targets may be morphological, functional or biochemical in nature and are preferably phenotypic. In certain preferred embodiments a determinant is a protein that is differentially expressed (over- or under-expressed) by specific cell types or by cells under certain conditions (e.g., during specific points of the cell cycle or cells in a particular niche). For the purposes of the instant invention a determinant preferably is differentially expressed on aberrant cancer cells and may comprise a DLL3 protein, or any of its splice variants, isoforms or family members, or specific domains, regions or epitopes thereof. An "antigen", "immunogenic determinant", "antigenic determinant" or "immunogen" means any protein or any fragment, region or domain thereof that can stimulate an immune response when introduced into an immunocompetent animal and is recognized by the antibodies produced from the immune response. The presence or absence of the determinants contemplated herein may be used to identify a cell, cell subpopulation or tissue (e.g., tumors, tumorigenic cells or CSCs).

As set forth below in the Examples, selected embodiments of the invention comprise murine antibodies that immunospecifically bind to DLL3, which can be considered "source" antibodies. In other embodiments, antibodies contemplated by the invention can be derived from such "source" antibodies through optional modification of the constant region or the epitope-binding amino acid sequences of the source antibody. In one embodiment an antibody is "derived" from a source antibody if selected amino acids in the source antibody are altered through deletion, mutation, substitution, integration or combination. In another embodiment, a "derived" antibody is one in which fragments of the source antibody (e.g., one or more CDRs) are combined with or incorporated into an acceptor antibody sequence to provide the derivative antibody (e.g. chimeric or humanized antibodies). These "derived" (e.g. humanized or CDR-grafted) antibodies can be generated using standard molecular biological techniques for various reasons such as, for example, to improve affinity for the determinant; to improve production and yield in cell culture; to reduce immunogenicity in vivo; to reduce toxicity; to facilitate conjugation of an active moiety; or to create a multispecific antibody. Such antibodies may also be derived from source antibodies through modification of the mature molecule (e.g., glycosylation patterns or pegylation) by chemical means or post-translational modification.

Any of the disclosed light and heavy chain CDRs derived from the murine variable region amino acid sequences set forth in FIG. 6A or FIG. 6B may be combined with acceptor antibodies or rearranged to provide optimized anti-human DLL3 (e.g. humanized or chimeric) antibodies. That is, one or more of the CDRs derived or obtained from the contiguous light chain variable region amino acid sequences set forth in FIG. 6A or the contiguous heavy chain variable region amino acid sequences set forth in FIG. 6B (together SEQ ID NOS: 21-387, odd numbers) may be incorporated in an anti-DLL3 antibody and, in some embodiments, in a CDR grafted or humanized antibody that immunospecifically associates with one or more DLL3 isoforms. Examples of "derived" light and heavy chain variable region amino acid sequences of such humanized antibodies are also set forth in FIGS. 6A and 6B (SEQ ID NOS: 389-407, odd numbers).

2. Antibody Generation and Production

Antibodies of the invention can be produced using a variety of methods known in the art.

A. Production of Polyclonal Antibodies in Host Animals

The production of polyclonal antibodies in various host animals is well known in the art (see for example, Harlow and Lane (Eds.) (1988) Antibodies: A Laboratory Manual, CSH Press; and Harlow et al. (1989) Antibodies, NY, Cold Spring Harbor Press). In order to generate polyclonal antibodies, an immunocompromised animal is immunized with an antigenic protein or cells or preparations comprising an antigenic protein. After a period of time, polyclonal antibody-containing serum is obtained by bleeding or sacrificing the animal. The serum may be used in the form obtained from the animal or the antibodies may be partially or fully purified to provide immunoglobulin fractions or homogeneous antibody preparations.

Any form of antigen, or cells or preparations containing the antigen, can be used to generate an antibody that is specific for a determinant. The term "antigen" is used in a broad sense and may comprise any immunogenic fragment or determinant of the selected target including a single epitope, multiple epitopes, single or multiple domains or the ECD. The antigen may be an isolated full-length protein, a cell surface protein (e.g., immunizing with cells expressing at least a portion of the antigen on their surface), or a soluble protein (e.g., immunizing with only the ECD portion of the protein). The antigen may be produced in a genetically modified cell. Any of the aforementioned antigens may be used alone or in combination with one or more immunogenicity enhancing adjuvants known in the art. The DNA encoding the antigen may be genomic or non-genomic (e.g., cDNA) and may encode at least a portion of the ECD, sufficient to elicit an immunogenic response. Any genetic vectors may be employed to transform the cells in which the antigen is expressed, including but not limited to adenoviral vectors, lentiviral vectors, plasmids, and non-viral vectors, such as cationic lipids.

B. Monoclonal Antibodies

In one embodiment, the invention contemplates use of monoclonal antibodies. As known in the art, the term "monoclonal antibody" or "mAb" refers to an antibody obtained from a population of substantially homogeneous antibodies, i.e., the individual antibodies comprising the population are identical except for possible mutations (e.g., naturally occurring mutations), that may be present in minor amounts.

Monoclonal antibodies can be prepared using a wide variety of techniques known in the art including hybridoma, recombinant techniques, phage display technologies, transgenic animals (e.g., a XenoMouse®) or some combination thereof. For example, monoclonal antibodies can be produced using hybridoma and biochemical and genetic engineering techniques such as described in more detail in An, Zhigiang (ed.) *Therapeutic Monoclonal Antibodies: From Bench to Clinic*, John Wiley and Sons, 1$^{st}$ ed. 2009; Shire et. al. (eds.) *Current Trends in Monoclonal Antibody Development and Manufacturing*, Springer Science+Business Media LLC, 1$^{st}$ ed. 2010; Harlow et al., *Antibodies: A Laboratory Manual*, Cold Spring Harbor Laboratory Press, 2nd ed. 1988; Hammerling, et al., in: *Monoclonal Antibodies and T-Cell Hybridomas* 563-681 (Elsevier, N.Y., 1981). Following production of multiple monoclonal antibodies that bind specifically to a determinant, a particularly effective antibody may be selected through various screening processes, based on, for example, its affinity for the determinant. Antibodies contemplated by the invention include antibodies in which the epitope binding sequence is further altered, for example, to improve affinity for the target, to improve its production in cell culture, to reduce its immunogenicity in vivo, to create a multispecific antibody, etc. A more detailed description of monoclonal antibody production and screening is set out below and in the appended Examples.

C. Chimeric and Humanized Antibodies

In another embodiment, the antibodies of the invention may comprise chimeric antibodies derived from covalently joined protein segments from at least two different species or class of antibodies. The term "chimeric" antibodies is directed to constructs in which a portion of the heavy and/or light chain is identical or homologous to corresponding sequences in antibodies derived from a particular species or belonging to a particular antibody class or subclass, while the remainder of the chain(s) is identical or homologous to corresponding sequences in antibodies derived from another species or belonging to another antibody class or subclass, as well as fragments of such antibodies (U.S. Pat. No. 4,816,567; Morrison et al., 1984, PMID: 6436822).

In one embodiment, a chimeric antibody may comprise murine VH and VL amino acid sequences and constant regions derived from human sources, for example, humanized antibodies as described below. In some embodiments, the antibodies can be "CDR-grafted", where the antibody comprises one or more CDRs from a particular species or belonging to a particular antibody class or subclass, while the remainder of the antibody chain(s) is/are identical with or homologous to a corresponding sequence in antibodies derived from another species or belonging to another antibody class or subclass. For use in humans, selected rodent CDRs, e.g., mouse CDRs may be grafted into a human antibody, replacing one or more of the naturally occurring CDRs of the human antibody. These constructs generally have the advantages of providing full strength antibody functions, e.g., complement dependent cytotoxicity (CDC) and antibody-dependent cell-mediated cytotoxicity (ADCC) while reducing unwanted immune responses to the antibody by the subject.

Similar to the CDR-grafted antibody is a "humanized" antibody. As used herein, "humanized" forms of non-human (e.g., murine) antibodies are chimeric antibodies that comprise amino acid sequences derived from one or more non-human immunoglobulins. In one embodiment, a humanized antibody is a human immunoglobulin (recipient or acceptor antibody) in which residues from a CDR of the recipient are replaced by residues from one or more CDRs of a non-human species (donor antibody) such as mouse, rat, rabbit, or non-human primate. In certain preferred embodiments, residues in one or more FRs in the variable domain of the human immunoglobulin are replaced by corresponding non-human residues from the donor antibody to help maintain the appropriate three-dimensional configuration of the grafted CDR(s) and thereby improve affinity. This can be referred to as the introduction of "back mutations". Furthermore, humanized antibodies may comprise residues that are not found in the recipient antibody or in the donor antibody to, for example, further refine antibody performance.

Various sources can be used to determine which human sequences to use in the humanized antibodies. Such sources include human germline sequences that are disclosed, for example, in Tomlinson, I. A. et al. (1992) *J. Mol. Biol.* 227:776-798; Cook, G. P. et al. (1995) *Immunol. Today* 16: 237-242; Chothia, D. et al. (1992) *J. Mol. Biol.* 227:799-817; and Tomlinson et al. (1995) *EMBO J* 14:4628-4638; the V-BASE directory (VBASE2-Retter et al., *Nucleic Acid Res.* 33; 671-674, 2005) which provides a comprehensive directory of human immunoglobulin variable region sequences (compiled by Tomlinson, I. A. et al. MRC Centre for Protein Engineering, Cambridge, UK); or consensus human FRs described, for example, in U.S. Pat. No. 6,300,064.

CDR grafting and humanized antibodies are described, for example, in U.S. Pat. Nos. 6,180,370 and 5,693,762. For further details, see, e.g., Jones et al., 1986, PMID: 3713831); and U.S. Pat. Nos. 6,982,321 and 7,087,409.

Another method is termed "humaneering" which is described, for example, in U.S.P.N. 2005/0008625. In another embodiment a non-human antibody may be modified by specific deletion of human T-cell epitopes or "deimmunization" by the methods disclosed in WO 98/52976 and WO 00/34317.

In selected embodiments at least 60%, 65%, 70%, 75%, or 80% of the humanized or CDR grafted antibody heavy or light chain variable region amino acid residues will correspond to those of the recipient human sequences. In other embodiments at least 83%, 85%, 87% or 90% of the humanized antibody variable region residues will correspond to those of the recipient human sequences. In a further preferred embodiment, greater than 95% of each of the humanized antibody variable region residues will correspond to those of the recipient human sequences.

D. Human Antibodies

In another embodiment, the antibodies may comprise fully human antibodies. The term "human antibody" refers to an antibody which possesses an amino acid sequence that corresponds to that of an antibody produced by a human and/or has been made using any of the techniques for making human antibodies described below.

Human antibodies can be produced using various techniques known in the art. In one embodiment, recombinant human antibodies may be isolated by screening a recombinant combinatorial antibody library prepared using phage display. In one embodiment, the library is a scFv phage or yeast display library, generated using human VL and VH cDNAs prepared from mRNA isolated from B-cells.

Human antibodies can also be made by introducing human immunoglobulin loci into transgenic animals, e.g., mice in which the endogenous immunoglobulin genes have been partially or completely inactivated and human immunoglobulin genes have been introduced. Upon challenge, human antibody production is observed, which closely resembles that seen in humans in all respects, including gene rearrangement, assembly, and antibody repertoire. This approach is described, for example, in U.S. Pat. Nos. 5,545,807; 5,545,806; 5,569,825; 5,625,126; 5,633,425; 5,661,016, and 6,075,181 and 6,150,584 regarding XenoMouse® technology; and Lonberg and Huszar, 1995, PMID: 7494109). Alternatively, a human antibody may be prepared via immortalization of human B lymphocytes producing an antibody directed against a target antigen (such B lymphocytes may be recovered from an individual suffering from a neoplastic disorder or may have been immunized in vitro). See, e.g., Cole et al., *Monoclonal Antibodies and Cancer Therapy*, Alan R. Liss, p. 77 (1985); Boerner et al., 1991, PMID: 2051030; and U.S. Pat. No. 5,750,373.

E. Recombinant Production of Antibodies

Antibodies and fragments thereof may be produced or modified using genetic material obtained from antibody producing cells and recombinant technology (see, for example, Berger and Kimmel, Guide to Molecular Cloning Techniques, *Methods in Enzymology* vol. 152 Academic Press, Inc., San Diego, Calif.; Sambrook and Russell (Eds.) (2000) Molecular Cloning: *A Laboratory Manual* ($3^{rd}$ Ed.), NY, Cold Spring Harbor Laboratory Press; Ausubel et al.

(2002) *Short Protocols in Molecular Biology: A Compendium of Methods from Current Protocols in Molecular Biology*, Wiley, John & Sons, Inc.; and U.S. Pat. No. 7,709,611).

More particularly, another aspect of the invention pertains to nucleic acid molecules that encode the antibodies of the invention. The nucleic acids may be present in whole cells, in a cell lysate, or in a partially purified or substantially pure form. A nucleic acid is "isolated" or "rendered substantially pure" when purified away from other cellular components or other contaminants, e.g., other cellular nucleic acids or proteins, by standard techniques, including alkaline/SDS treatment, CsCl banding, column chromatography, agarose gel electrophoresis and others well known in the art. A nucleic acid of the invention can be, for example, DNA or RNA and may or may not contain intronic sequences. The term "nucleic acid", as used herein, includes genomic DNA, cDNA, RNA and artificial variants thereof (e.g., peptide nucleic acids), whether single-stranded or double-stranded. In a preferred embodiment, the nucleic acid is a cDNA molecule.

Nucleic acids of the invention can be obtained using standard molecular biology techniques. For antibodies expressed by hybridomas (e.g., hybridomas prepared from transgenic mice carrying human immunoglobulin genes as described further below), cDNAs encoding the light and heavy chains of the antibody made by the hybridoma can be obtained by standard PCR amplification or cDNA cloning techniques. For antibodies obtained from an immunoglobulin gene library (e.g., using phage display techniques), nucleic acid encoding the antibody can be recovered from the library.

Once DNA fragments encoding VH and VL segments are obtained, these DNA fragments can be further manipulated by standard recombinant DNA techniques, for example to convert the variable region genes to full-length antibody chain genes, to Fab fragment genes or to a scFv gene. In these manipulations, a VL- or VH-encoding DNA fragment is operatively linked to another DNA fragment encoding another protein, such as an antibody constant region or a flexible linker. The term "operatively linked", as used in this context, means that the two DNA fragments are joined such that the amino acid sequences encoded by the two DNA fragments remain in-frame.

The isolated DNA encoding the VH region can be converted to a full-length heavy chain gene by operatively linking the VH-encoding DNA to another DNA molecule encoding heavy chain constant regions ($C_H1$, $C_H2$ and $C_H3$). The sequences of human heavy chain constant region genes are known in the art (see e.g., Kabat, E. A., et al. (1991) Sequences of Proteins of Immunological Interest, Fifth Edition, U.S. Department of Health and Human Services, NIH Publication No. 91-3242) and DNA fragments encompassing these regions can be obtained by standard PCR amplification. The heavy chain constant region can be an IgG1, IgG2, IgG3, IgG4, IgA, IgE, IgM or IgD constant region, but most preferably is an IgG1 or IgG4 constant region. As discussed in more detail below an exemplary IgG1 constant region that is compatible with the teachings herein is set forth as SEQ ID NO: 6 in the appended sequence listing. For a Fab fragment heavy chain gene, the VH-encoding DNA can be operatively linked to another DNA molecule encoding only the heavy chain CH1 constant region.

The isolated DNA encoding the VL region can be converted to a full-length light chain gene (as well as a Fab light chain gene) by operatively linking the VL-encoding DNA to another DNA molecule encoding the light chain constant region, $C_L$. The sequences of human light chain constant region genes are known in the art (see e.g., Kabat, E. A., et al. (1991) Sequences of Proteins of Immunological Interest, Fifth Edition, U.S. Department of Health and Human Services, NIH Publication No. 91-3242) and DNA fragments encompassing these regions can be obtained by standard PCR amplification. The light chain constant region can be a kappa or lambda constant region, but most preferably is a kappa constant region. In this respect an exemplary compatible kappa light chain constant region is set forth as SEQ ID NO: 5 in the appended sequence listing.

The instant invention also provides vectors comprising such nucleic acids described above, which may be operably linked to a promoter (see, e.g., WO 86/05807; WO 89/01036; and U.S. Pat. No. 5,122,464); and other transcriptional regulatory and processing control elements of the eukaryotic secretory pathway. The invention also provides host cells harboring those vectors and host-expression systems. As used herein, the term "host-expression system" includes any kind of cellular system which can be engineered to generate either the nucleic acids or the polypeptides and antibodies of the invention. Such host-expression systems include, but are not limited to microorganisms (e.g., *E. coli* or *B. subtilis*) transformed or transfected with recombinant bacteriophage DNA or plasmid DNA; yeast (e.g., *Saccharomyces*) transfected with recombinant yeast expression vectors; or mammalian cells (e.g., COS, CHO-S, HEK-293T, 3T3 cells) harboring recombinant expression constructs containing promoters derived from the genome of mammalian cells or viruses (e.g., the adenovirus late promoter). The host cell may be co-transfected with two expression vectors, for example, the first vector encoding a heavy chain derived polypeptide and the second vector encoding a light chain derived polypeptide.

Methods of transforming mammalian cells are well known in the art. See, for example, U.S. Pat. Nos. 4,399,216, 4,912,040, 4,740,461, and 4,959,455. The host cell may also be engineered to allow the production of an antigen binding molecule with various characteristics (e.g. modified glycoforms or proteins having GnTIII activity).

For long-term, high-yield production of recombinant proteins stable expression is preferred. Accordingly, cell lines that stably express the selected antibody may be engineered using standard art recognized techniques and form part of the invention. Rather than using expression vectors that contain viral origins of replication, host cells can be transformed with DNA controlled by appropriate expression control elements (e.g., promoter or enhancer sequences, transcription terminators, polyadenylation sites, etc.), and a selectable marker. Any of the selection systems well known in the art may be used, including the glutamine synthetase gene expression system (the GS system) which provides an efficient approach for enhancing expression under certain conditions. The GS system is discussed in whole or part in connection with EP 0 216 846, EP 0 256 055, EP 0 323 997 and EP 0 338 841 and U.S. Pat. Nos. 5,591,639 and 5,879,936. Another preferred expression system for the development of stable cell lines is the Freedom™ CHO-S Kit (Life Technologies).

Once an antibody of the invention has been produced by recombinant expression or any other of the disclosed techniques, it may be purified or isolated by methods known in the art, meaning that it is identified and separated and/or recovered from its natural environment and separated from contaminants that would interfere with diagnostic or therapeutic uses for the antibody. Isolated antibodies include antibodies in situ within recombinant cells.

These isolated preparations may be purified using various art recognized techniques, such as, for example, ion exchange and size exclusion chromatography, dialysis, diafiltration, and affinity chromatography, particularly Protein A or Protein G affinity chromatography.

F. Post-Production Selection

No matter how obtained, antibody-producing cells (e.g., hybridomas, yeast colonies, etc.) may be selected, cloned and further screened for desirable characteristics including, for example, robust growth, high antibody production and desirable antibody characteristics such as high affinity for the antigen of interest. Hybridomas can be expanded in vitro in cell culture or in vivo in syngeneic immunocompromised animals. Methods of selecting, cloning and expanding hybridomas and/or colonies are well known to those of ordinary skill in the art. Once the desired antibodies are identified the relevant genetic material may be isolated, manipulated and expressed using common, art-recognized molecular biology and biochemical techniques.

The antibodies produced by naïve libraries (either natural or synthetic) may be of moderate affinity ($K_a$ of about $10^6$ to $10^7$ $M^{-1}$). To enhance affinity, affinity maturation may be mimicked in vitro by constructing antibody libraries (e.g., by introducing random mutations in vitro by using error-prone polymerase) and reselecting antibodies with high affinity for the antigen from those secondary libraries (e.g. by using phage or yeast display). WO 9607754 describes a method for inducing mutagenesis in a CDR of an immunoglobulin light chain to create a library of light chain genes.

Various techniques can be used to select antibodies, including but not limited to, phage or yeast display in which a library of human combinatorial antibodies or scFv fragments is synthesized on phages or yeast, the library is screened with the antigen of interest or an antibody-binding portion thereof, and the phage or yeast that binds the antigen is isolated, from which one may obtain the antibodies or immunoreactive fragments (Vaughan et al., 1996, PMID: 9630891; Sheets et al., 1998, PMID: 9600934; Boder et al., 1997, PMID: 9181578; Pepper et al., 2008, PMID: 18336206). Kits for generating phage or yeast display libraries are commercially available. There also are other methods and reagents that can be used in generating and screening antibody display libraries (see U.S. Pat. No. 5,223,409; WO 92/18619, WO 91/17271, WO 92/20791, WO 92/15679, WO 93/01288, WO 92/01047, WO 92/09690; and Barbas et al., 1991, PMID: 1896445). Such techniques advantageously allow for the screening of large numbers of candidate antibodies and provide for relatively easy manipulation of sequences (e.g., by recombinant shuffling).

VII. Antibody Derivatives

1. Modifications of the Fc Region

In addition to the various modifications to the variable region of the disclosed antibodies described herein, the antibodies may also comprise deletions, substitutions or modifications of the Fc region. Various amino acid residue substitutions, mutations and/or modifications may result in a compound with preferred characteristics which may advantageously enhance certain properties of the antibody. Such properties include, but are not limited to, pharmacokinetics, increased serum half-life, increased binding affinity or specificity, reduced immunogenicity, increased production, altered Fc ligand binding to an Fc receptor, enhanced ADCC or CDC, altered glycosylation, increased phagocytosis; and/or down regulation of cell surface receptors (e.g. B cell receptor). See, for example, Ravetch and Kinet, 1991, PMID: 1910686; Capel et al., 1994, PMID: 8069524; de Haas et al., 1995, PMID: 7561440; WO 97/34631; WO 04/029207; and U.S. Pat. No. 6,737,056 and 2003/0190311.

2. Altered Glycosylation

An embodiment of the invention is an antibody comprising modified glycosylation, for example, on the Fc domain (see, for example, Shields, et al., 2002, PMID: 11986321.) Engineered glycoforms (e.g., a hypofucosylated antibody) may be useful for a variety of purposes, including but not limited to enhancing or reducing effector function, increasing the affinity of the antibody for a target or facilitating production of the antibody. In certain embodiments where reduced effector function is desired, the molecule may be engineered to express an aglycosylated form. Amino acid substitutions that may result in elimination of one or more variable region FR glycosylation sites are well known (see e.g. U.S. Pat. Nos. 5,714,350 and 6,350,861). Engineered glycoforms may be generated by any method known to one skilled in the art, for example by using recombinant technology, for example, co-expression of one or more enzymes (e.g. N-acetylglucosaminyltransferase III (GnTI11)), or post-expression modification (see, for example, WO 2012/117002).

3. Multivalent Antibodies

The disclosed antibodies or antibody fragments may be monovalent or multivalent. Monovalent antibodies have a single binding site whereas multivalent antibodies (e.g. bi or trivalent) comprise more than one target or antigen binding site. In each case at least one of the binding sites will comprise an epitope, motif or domain associated with the target. Multivalent antibodies may immunospecifically bind to different epitopes or antigenic determinants of the desired target molecule or, in one embodiment of a bivalent antibody, may immunospecifically bind to both the target molecule as well as a heterologous epitope on a different structure, such as a heterologous polypeptide or solid support material. In a further embodiment a "heteroconjugate" antibody comprises multiple antibodies in which, for example, one of the antibodies in the heteroconjugate can be coupled to avidin, the other to biotin. For further discussion on bispecific and other multivalent antibodies and their production, see for example, U.S.P.N.s. 2009/0130105, 2009/0155255; WO 94/04690; Suresh et al., 1986, PMID: 3724461; and WO 96/27011.

4. Homologous Proteins and Nucleic Acids

Contemplated herein are certain polypeptides (e.g. antigens or antibodies) that exhibit "sequence identity", "sequence similarity" or "sequence homology" to the polypeptides of the invention. A "homologous" polypeptide may exhibit 65%, 70%, 75%, 80%, 85%, or 90% sequence identity. In other embodiments a "homologous" polypeptides may exhibit 93%, 95% or 98% sequence identity. Such identity, similarity or homology can be measured using various sequence analysis software programs, such as BLAST Gap, Bestfit or FASTA.

Residue positions which are not identical may differ by conservative amino acid substitutions or by non-conservative amino acid substitutions. A "conservative amino acid substitution" is one in which an amino acid residue is substituted by another amino acid residue having a side chain with similar chemical properties (e.g., charge or hydrophobicity). In general, a conservative amino acid substitution will not substantially change the functional properties of a protein. In cases where two or more amino acid sequences differ from each other by conservative substitutions, the percent sequence identity or degree of similarity may be adjusted upwards to correct for the conservative nature of the substitution. In cases where there is a substitution with a non-conservative amino acid, in preferred embodiments the polypeptide exhibiting sequence identity will retain the desired function or activity of the polypeptide of the invention (e.g., antibody.)

Also contemplated herein are nucleic acids that that exhibit "sequence identity", "sequence similarity" or "sequence homology" to the nucleic acids of the invention. A "homologous sequence" means a sequence of nucleic acid molecules exhibiting at least about 65%, 70%, 75%, 80%, 85%, or 90% sequence identity. In other embodiments, a "homologous sequence" of nucleic acids may exhibit 93%, 95% or 98% sequence identity to the reference nucleic acid.

VIII. Characteristics of Antibodies

The disclosed antibodies may exhibit certain characteristics, which may be screened for; imparted by immunizing the antibody-producing animal with a particular antigen; or engineered through recombinant genetic techniques as described above, to enhance or refine certain desirable characteristics such as affinity, pharmacokinetics, safety profile etc.

1. Internalizing, Neutralizing and Depleting Antibodies

In particularly preferred embodiments the antibodies may comprise internalizing antibodies such that the antibody will bind to a determinant and will be internalized (along with any conjugated pharmaceutically active moiety) into an aberrant cell including tumorigenic cells. Internalization may occur in vitro or in vivo. For therapeutic applications, internalization will preferably occur in vivo in a subject in need thereof. The number of antibody molecules internalized may be sufficient to kill an antigen-expressing cell, especially an antigen-expressing tumorigenic cell. Depending on the potency of the antibody or, in some instances, antibody drug conjugate, the uptake of a single antibody molecule into the cell may be sufficient to kill the target cell to which the antibody binds. Whether an antibody internalizes upon binding to a mammalian cell can be determined by various assays including those described in U.S. Pat. No. 7,619,068.

In other selected embodiments the antibodies of the invention may be "antagonists" or "neutralizing" antibodies, meaning that the antibody may associate with a determinant and block or inhibit the activities of said determinant either directly or by preventing association of the determinant with a binding partner such as a ligand or a receptor, thereby interrupting the biological response that otherwise would result from the interaction of the molecules. A neutralizing or antagonist antibody will substantially inhibit binding of the determinant to its ligand or substrate when an excess of antibody reduces the quantity of binding partner bound to the determinant by at least about 20%, 30%, 40%, 50%, 60%, 70%, 80%, 85%, 90%, 95%, 97%, 99% or more as measured, for example, by target molecule activity or in an in vitro competitive binding assay. The modified activity may be measured directly using art recognized techniques or may be measured by the impact the altered activity has downstream (e.g., oncogenesis or cell survival).

In a further embodiment the antibodies or antibody drug conjugates disclosed herein will be "depleting" antibodies, meaning that the antibody will associate with a determinant on or near a cell surface and will induce the death or elimination of the cell (e.g., by CDC, ADCC or introduction of a cytotoxic agent). Preferably a depleting antibody will be able to incapacitate or eliminate at least 20%, 30%, 40%, 50%, 60%, 70%, 80%, 85%, 90%, 95%, 97%, or 99% of cells expressing a determinant in a defined cell population, e.g. DLL3 expressing tumor cells. In some embodiments the cell population may comprise isolated tumorigenic cells. In other embodiments the cell population may comprise whole tumor samples or heterogeneous tumor extracts that comprise tumorigenic cells. Standard biochemical techniques may be used to monitor and quantify the depletion of tumor cells.

2. Binding Affinity

Disclosed herein are antibodies that have a high binding affinity for a specific determinant e.g. DLL3. The term "$K_D$" refers to the dissociation constant or apparent affinity of a particular antibody-antigen interaction. An antibody of the invention can immunospecifically bind its target antigen when the dissociation constant $K_D$ ($k_{off}/k_{on}$) is $\leq 10^{-7}$ M. The antibody specifically binds antigen with high affinity when the $K_D$ is $\leq 5 \times 10^{-9}$ M, and with very high affinity when the $K_D$ is $\leq 5 \times 10^{-10}$ M. In one embodiment of the invention, the antibody has a $K_D$ of $\leq 10^{-9}$ M and an off-rate of about $1 \times 10^{-4}$/sec. In one embodiment of the invention, the off-rate is $<1 \times 10^{-5}$/sec. In other embodiments of the invention, the antibodies will bind to a determinant with a $K_D$ of between about $10^{-7}$ M and $10^{-10}$ M, and in yet another embodiment it will bind with a $K_D < 2 \times 10^{-10}$ M. Still other selected embodiments of the invention comprise antibodies that have a $K_D$ ($k_{off}/k_{on}$) of less than $10^{-6}$ M, less than $5 \times 10^{-6}$ M, less than $10^{-7}$ M, less than $5 \times 10^{-7}$ M, less than $10^{-8}$ M, less than $5 \times 10^{-8}$ M, less than $10^{-9}$ M, less than $5 \times 10^{-9}$ M, less than $10^{-10}$ M, less than $5 \times 10^{-10}$ M, less than $10^{-11}$ M, less than $5 \times 10^{-11}$ M, less than $10^{-12}$ M, less than $5 \times 10^{-12}$ M, less than $10^{-13}$ M, less than $5 \times 10^{-13}$ M, less than $10^{-14}$ M, less than $5 \times 10^{-14}$ M, less than $10^{-15}$ M or less than $5 \times 10^{-15}$ M.

In certain embodiments, an antibody of the invention that immunospecifically binds to a determinant e.g. DLL3 may have an association rate constant or $k_{on}$ (or $k_a$) rate (antibody+antigen $(Ag)^{k_{on}} \leftarrow$ antibody-Ag) of at least $10^5$ $M^{-1}s^{-1}$, at least $2 \times 10^5$ $M^{-1}s^{-1}$, at least $5 \times 10^5$ $M^{-1}s^{-1}$, at least $10^6$ $M^{-1}s^{-1}$, at least $5 \times 10^6$ $M^{-1}s^{-1}$, at least $10^7$ $M^{-1}s^{-1}$, at least $5 \times 10^7$ $M^{-1}s^{-1}$, or at least $10^8$ $M^{-1}s^{-1}$.

In another embodiment, an antibody of the invention that immunospecifically binds to a determinant e.g. DLL3 may have a disassociation rate constant or $k_w$ (or $k_d$) rate (antibody+antigen $(Ag)^{k_{off}} \leftarrow$ antibody-Ag) of less than $10^{-1}$ $s^{-1}$, less than $5 \times 10^{-1}$ $s^{-1}$, less than $10^{-2}$ $s^{-1}$, less than $5 \times 10^{-2}$ $s^{-1}$, less than $10^{-3}$ $s^{-1}$, less than $5 \times 10^{-3}$ $s^{-1}$, less than $10^{-4}$ $s^{-1}$, less than $5 \times 10^{-4}$ $s^{-1}$, less than $10^{-5}$ $s^{-1}$, less than $5 \times 10^{-5}$ $s^{-1}$, less than $10^{-6}$ $s^{-1}$, less than $5 \times 10^{-6}$ $s^{-1}$ less than $10^{-7}$ $s^{-1}$, less than $5 \times 10^{-7}$ $s^{-1}$, less than $10^{-8}$ $s^{-1}$, less than $5 \times 10^{-8}$ $s^{-1}$, less than $10^{-9}$ $s^{-1}$, less than $5 \times 10^{-9}$ $s^{-1}$ or less than $10^{-10}$ $s^{-1}$.

Binding affinity may be determined using various techniques known in the art, for example, surface plasmon resonance, bio-layer interferometry, dual polarization interferometry, static light scattering, dynamic light scattering, isothermal titration calorimetry, ELISA, analytical ultracentrifugation, and flow cytometry.

3. Binning and Epitope Mapping

Antibodies disclosed herein may be characterized in terms of the discrete epitope with which they associate. An "epitope" is the portion(s) of a determinant to which the antibody or immunoreactive fragment specifically binds. Immunospecific binding can be confirmed and defined based on binding affinity, as described above, or by the preferential recognition by the antibody of its target antigen in a complex mixture of proteins and/or macromolecules (e.g. in competition assays). A "linear epitope", is formed from contiguous amino acids in the antigen that allow for immunospecific binding of the antibody. The ability to preferentially bind linear epitopes is typically maintained even when the antigen is denatured. Conversely, a "conformational epitope", usually comprises non-contiguous amino acids in the antigen's amino acid sequence but in the context of the antigen's secondary, tertiary or quaternary structure, are sufficiently physically near each other to be bound concomitantly by a single antibody. When antigens with conformational epitopes are denatured, the antibody will no longer recognize the antigen. An epitope typically includes at least 3, and more usually, at least 5 or 8-10 or 12-20 amino acids in a unique spatial conformation.

It is also possible to characterize the antibodies of the invention in terms of the group or "bin" to which they belong. "Binning" refers to the use of competitive antibody binding assays to identify pairs of antibodies that are incapable of binding an immunogenic determinant simultaneously, thereby identifying antibodies that "compete" for binding. Competing antibodies may be determined by an assay in which the antibody or immunologically functional fragment being tested prevents or inhibits specific binding of a reference antibody to a common antigen. The test antibody can prevent or inhibit the binding of the reference antibody because both the test antibody and the reference antibody may have the same epitope, or they may have overlapping epitopes, or they may have epitopes that are sterically proximate to each other. It is possible to determine whether one antibody "competes" with another antibody or antibody fragment by performing competition experiments. Such competition experiments can be performed with isolated antibodies or with cell culture (e.g., hybridoma) supernatants. Empirical assignment of antibodies to individual bins can provide information that may be indicative of the therapeutic, diagnostic or reagent potential of the antibodies in a particular bin.

One general principal on which competition assays are based and which is contemplated herein comprises an assay in which purified antigen (or cells overexpressing the antigen) is coated onto a surface. A reference antibody, which is not labeled, is exposed to the coated surface under saturating conditions. The ability of a second labeled test antibody to compete or to bind to the same coated surface is determined using various art-recognized techniques, such as, for example, immunoassays such as western blots, radioimmunoassays, enzyme linked immunosorbent assay (ELISA), "sandwich" immunoassays, immunoprecipitation assays, precipitin reactions, gel diffusion precipitin reactions, immunodiffusion assays, agglutination assays, complement-fixation assays, immunoradiometric assays, fluorescent immunoassays and protein A immunoassays. Such immunoassays are routine and well known in the art (see, Ausubel et al, eds, (1994) *Current Protocols in Molecular Biology*, Vol. 1, John Wiley & Sons, Inc., New York). Additionally, cross-blocking assays may be used (see, for example, WO 2003/48731; and Harlow et al. (1988) *Antibodies, A Laboratory Manual*, Cold Spring Harbor Laboratory, Ed Harlow and David Lane).

Other technologies used to determine competitive inhibition (and hence "bins"), include: surface plasmon resonance using, for example, the BIAcore™ 2000 system (GE Healthcare); bio-layer interferometry using, for example, a ForteBio® Octet RED (ForteBio); or flow cytometry using, for example, a FACSCanto II (BD Biosciences) or the multiplex LUMINEX™ detection assay (Luminex).

"Surface plasmon resonance," refers to an optical phenomenon that allows for the analysis of real-time specific interactions by detection of alterations in protein concentrations within a biosensor matrix. Luminex is a bead-based immunoassay that utilizes beads to immobilize the antigen against which binding is being tested. The ability of Luminex to analyze up to 100 different types of beads simultaneously provides almost unlimited antigen and/or antibody surfaces, resulting in improved throughput and resolution in antibody epitope profiling over a biosensor assay.

In one embodiment, a technique that can be used to determine whether a test antibody "competes" for binding with a reference antibody is "bio-layer interferometry", an optical analytical technique that analyzes the interference pattern of white light reflected from two surfaces: a layer of immobilized protein on a biosensor tip, and an internal reference layer. Any change in the number of molecules bound to the biosensor tip causes a shift in the interference pattern that can be measured in real-time. Such biolayer interferometry assays may be conducted using a ForteBio® Octet RED machine as follows. A reference antibody (Ab1) is captured onto an anti-mouse capture chip, a high concentration of non-binding antibody is then used to block the chip and a baseline is collected. Monomeric, recombinant target protein is then captured by the specific antibody (Ab1) and the tip is dipped into a well with either the same antibody (Ab1) as a control or into a well with a different test antibody (Ab2). If no further binding occurs, as determined by comparing binding levels with the control Ab1, then Ab1 and Ab2 are determined to be "competing" antibodies. If additional binding is observed with Ab2, then Ab1 and Ab2 are determined not to compete with each other. This process can be expanded to screen large libraries of unique antibodies using a full row of antibodies in a 96-well plate representing unique bins.

In preferred embodiments a test antibody will compete with a reference antibody if the reference antibody inhibits specific binding of the test antibody to a common antigen by at least 40%, 45%, 50%, 55%, 60%, 65%, 70% or 75%. In other embodiments, binding is inhibited by at least 80%, 85%, 90%, 95%, or 97% or more.

Once a bin, encompassing a group of competing antibodies, has been determined further characterization can be carried out to determine the specific domain or epitope on the antigen to which that group of antibodies binds. Domain-level epitope mapping may be performed using a modification of the protocol described by Cochran et al., 2004, PMID: 15099763. Fine epitope mapping is the process of determining the specific amino acids on the antigen that comprise the epitope of a determinant to which the antibody binds.

In certain embodiments fine epitope mapping can be performed using phage or yeast display. Other compatible epitope mapping techniques include alanine scanning mutants, peptide blots (Reineke, 2004, PMID: 14970513), or peptide cleavage analysis. In addition, methods such as epitope excision, epitope extraction and chemical modification of antigens can be employed (Tomer, 2000, PMID: 10752610) using enzymes such as proteolytic enzymes (e.g., trypsin, endoproteinase Glu-C, endoproteinase Asp-N, chymotrypsin, etc.); chemical agents such as succinimidyl esters and their derivatives, primary amine-containing compounds, hydrazines and carbohydrazines, free amino acids, etc. In another embodiment Modification-Assisted Profiling, also known as Antigen Structure-based Antibody Profiling can be used to categorize large numbers of monoclonal antibodies directed against the same antigen according to the similarities of the binding profile of each antibody to chemically or enzymatically modified antigen surfaces (U.S.P.N. 2004/0101920).

Once a desired epitope on an antigen is determined, it is possible to generate additional antibodies to that epitope, e.g., by immunizing with a peptide comprising the selected epitope using techniques described herein.

IX. Antibody Drug Conjugates

In certain preferred embodiments the antibodies of the invention may be conjugated with pharmaceutically active or diagnostic moieties to form an "antibody drug conjugate" (ADC) or "antibody conjugate". The term "conjugate" is used broadly and means the covalent or non-covalent association of any pharmaceutically active or diagnostic moiety with an antibody of the instant invention regardless of the method of association. In certain embodiments the association is effected through a lysine or cysteine residue of the antibody. In particularly preferred embodiments the pharmaceutically active or diagnostic moieties may be conjugated to the antibody via one or more site-specific free cysteine(s). The disclosed ADCs may be used for therapeutic and diagnostic purposes.

The ADCs of the instant invention may be used to deliver cytotoxins or other payloads to the target location (e.g., tumorigenic cells and/or cells expressing DLL3). As used herein the terms "drug" or "warhead" may be used interchangeably and will mean a biologically active or detectable molecule or drug, including anti-cancer agents as described below. A "payload" may comprise a drug or "warhead" in combination with an optional linker compound. The "warhead" on the conjugate may comprise peptides, proteins or prodrugs which are metabolized to an active agent in vivo, polymers, nucleic acid molecules, small molecules, binding agents, mimetic agents, synthetic drugs, inorganic molecules, organic molecules and radioisotopes. In an advantageous embodiment, the disclosed ADCs will direct the bound payload to the target site in a relatively unreactive, non-toxic state before releasing and activating the payload. This targeted release of the payload is preferably achieved through stable conjugation of the payloads (e.g., via one or more cysteines on the antibody) and the relatively homogeneous composition of the ADC preparations which minimize over-conjugated toxic species. Coupled with drug linkers that are designed to largely release the payload once it has been delivered to the tumor site, the conjugates of the instant invention can substantially reduce undesirable non-specific toxicity. This advantageously provides for relatively high levels of the active cytotoxin at the tumor site while minimizing exposure of non-targeted cells and tissue thereby providing an enhanced therapeutic index.

While preferred embodiments of the invention comprise payloads of therapeutic moieties (e.g., cytotoxins), other payloads such as diagnostic agents and biocompatible modifiers may benefit from the targeted release provided by the disclosed conjugates. Accordingly, any disclosure directed to exemplary therapeutic payloads is also applicable to payloads comprising diagnostic agents or biocompatible modifiers as discussed herein unless otherwise dictated by context. The selected payload may be covalently or non-covalently linked to, the antibody and exhibit various stoichiometric molar ratios depending, at least in part, on the method used to effect the conjugation. The conjugates of the instant invention may be represented by the formula:

Ab-[L-D]n or a pharmaceutically acceptable salt thereof wherein
 a) Ab comprises an anti-DLL3 antibody;
 b) L comprises an optional linker;
 c) D comprises a drug; and
 d) n is an integer from about 1 to about 20.

Conjugates according to the aforementioned formula may be fabricated using a number of different linkers and drugs and that conjugation methodology will vary depending on the selection of components. As such, any drug or drug linker compound that associates with a reactive residue (e.g., cysteine or lysine) of the disclosed antibodies are compatible with the teachings herein. Similarly, any reaction conditions that allow for site-specific conjugation of the selected drug to an antibody are within the scope of the present invention. Notwithstanding the foregoing, particularly preferred embodiments of the instant invention comprise selective conjugation of the drug or drug linker to free cysteines using stabilization agents in combination with mild reducing agents as described herein. Such reaction conditions tend to provide more homogeneous preparations with less non-specific conjugation and contaminants and correspondingly less toxicity.

Exemplary payloads compatible with the teachings herein are listed below:

1. Therapeutic Moieties

The antibodies of the invention may be conjugated, linked, fused, associated or used in combination with a pharmaceutically active moiety, including a therapeutic moiety or therapeutic agent such as an anti-cancer agent including, but not limited to, cytotoxic agents, cytostatic agents, anti-angiogenic agents, debulking agents, chemotherapeutic agents, radiotherapeutic agents, targeted anti-cancer agents, biological response modifiers, cancer vaccines, cytokines, hormone therapies, anti-metastatic agents and immunotherapeutic agents.

Examples of therapeutic moieties contemplated by the invention comprise 1-dehydrotestosterone, anthramycins, actinomycin D, bleomycin, colchicin, cyclophosphamide, cytochalasin B, dactinomycin (formerly actinomycin), dihydroxy anthracin, dione, emetine, epirubicin, ethidium bromide, etoposide, glucocorticoids, gramicidin D, lidocaine, maytansinoids such as DM-1 and DM-4 (Immunogen), mithramycin, mitomycin, mitoxantrone, paclitaxel, procaine, propranolol, puromycin, tenoposide, tetracaine, and homologs, derivatives pharmaceutically acceptable salts or solvates or acids of any of the above.

Additional compatible cytotoxins comprise dolastatins and auristatins, including monomethyl auristatin E (MMAE) and monomethyl auristatin F (MMAF) (Seattle Genetics), amanitins such as alpha-amanitin, beta-amanitin, gamma-amanitin or epsilon-amanitin (Heidelberg Pharma), DNA minor groove binding agents such as duocarmycin derivatives (Syntarga), alkylating agents such as modified or dimeric pyrrolobenzodiazepines (PBD) (Spirogen), mechlorethamine, thioepa, chlorambucil, melphalan, carmustine (BCNU), lomustine (CCNU), cyclothosphamide, busulfan, dibromomannitol, streptozotocin, mitomycin C and cisdichlorodiamine platinum (II) (DDP) cisplatin, splicing inhibitors such as meayamycin analogs or derivatives (e.g., FR901464 as set forth in U.S. Pat. No. 7,825,267), tubular binding agents such as epothilone analogs and paclitaxel and DNA damaging agents such as calicheamicins and esperamicins, antimetabolites such as methotrexate, 6-mercaptopurine, 6-thioguanine, cytarabine, and 5-fluorouracil decarbazine, anti-mitotic agents such as vinblastine and vincristine and anthracyclines such as daunorubicin (formerly daunomycin) and doxorubicin and pharmaceutically acceptable salts or solvates, acids or derivatives of any of the above. Contemplated within the invention are also the therapeutic moieties listed in WO 03/075957 and U.S.P.N. 2009/0155255.

Furthermore, in one embodiment the antibodies of the instant invention may be associated with anti-CD3 binding molecules to recruit cytotoxic T-cells and have them target tumorigenic cells (BiTE technology; see e.g., Fuhrmann et. al. (2010) Annual Meeting of AACR Abstract No. 5625).

In certain preferred embodiments, the ADCs of the invention may comprise PBDs as a cytotoxic agent and pharmaceutically acceptable salts or solvates, acids or derivatives thereof. PBDs are alkylating agents that exert antitumor activity by covalently binding to DNA in the minor groove and inhibiting nucleic acid synthesis. PBDs have been shown to have potent antitumor properties while exhibiting minimal bone marrow depression. PBDs compatible with the invention may be linked to an antibody using several types of linkers (e.g., a peptidyl linker comprising a maleimido moiety with a free sulfhydryl), and in certain embodiments are dimeric in form (i.e., PBD dimers). Compatible PBDs (and optional linkers) that may be conjugated to the disclosed antibodies are described, for example, in U.S. Pat. Nos. 6,362,331, 7,049,311, 7,189,710, 7,429,658, 7,407,951, 7,741,319, 7,557,099, 8,034,808, 8,163,736, 2011/0256157 and WO2011/130613, WO2011/128650 and WO2011/130616.

Examples of PBD compounds compatible with the instant invention are shown immediately below.

$^{211}$At. Other radionuclides are also available as diagnostic and therapeutic agents, especially those in the energy range of 60 to 4,000 keV.

Antibodies of the invention may also be conjugated to biological response modifiers. For example, in particularly preferred embodiments the drug moiety can be a polypeptide possessing a desired biological activity. Such proteins may include, for example, a toxin such as abrin, ricin A, Onconase (or another cytotoxic RNase), *pseudomonas* exotoxin, cholera toxin, diphtheria toxin; an apoptotic agent such as tumor necrosis factor e.g. TNF-α or TNF-β, α-interferon, β-interferon, nerve growth factor, platelet derived growth factor, tissue plasminogen activator, AIM I (WO 97/33899), AIM II (WO 97/34911), Fas Ligand (Takahashi et al., 1994, PMID: 7826947), and VEGI (WO 99/23105), a thrombotic agent, an anti-angiogenic agent, e.g., angiostatin or endostatin, a lymphokine, for example, interleukin-1 (IL-1), interleukin-2 (IL-2), interleukin-6 (IL-6), granulocyte macrophage colony stimulating factor (GM-CSF), and granulocyte colony stimulating factor (G-CSF), or a growth factor e.g., growth hormone (GH).

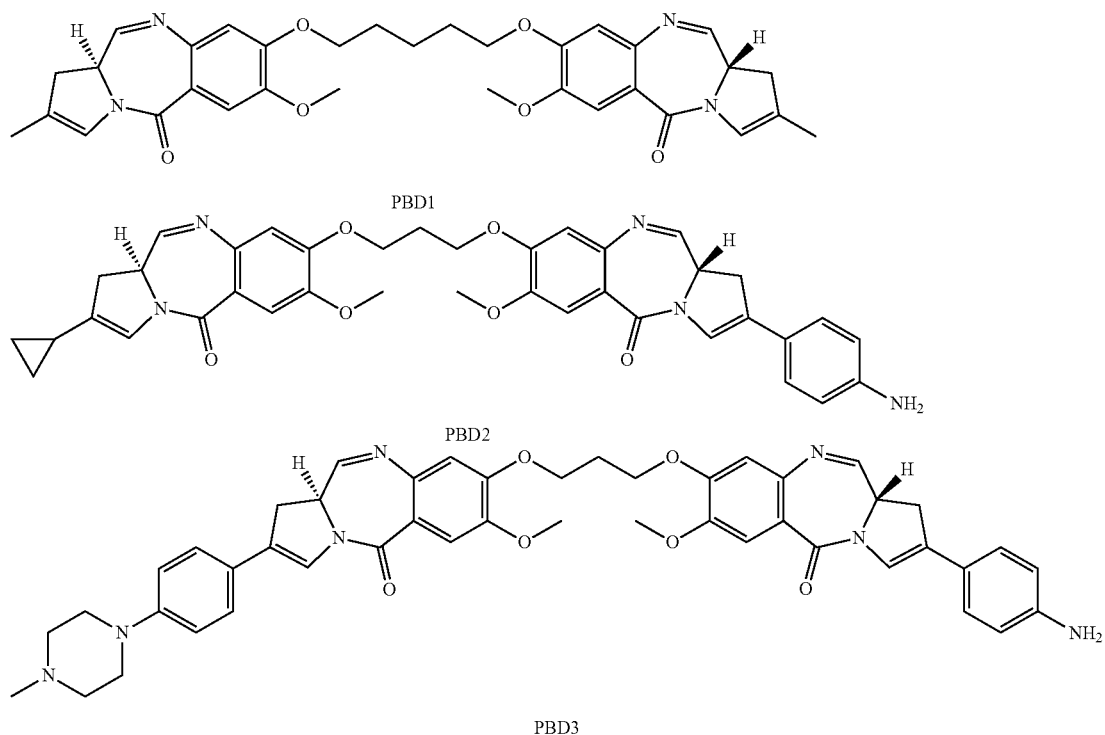

In further embodiments ADCs of the invention may comprise therapeutic radioisotopes conjugated using appropriate linkers. Exemplary radioisotopes that may be compatible with such embodiments include, but are not limited to, iodine ($^{131}$I, $^{125}$I, $^{123}$I, $^{121}$I,), carbon ($^{14}$C), copper ($^{62}$Cu, $^{64}$Cu, $^{67}$Cu), sulfur ($^{35}$S), tritium ($^{3}$H), indium ($^{115}$In, $^{113}$In, $^{112}$In, $^{111}$In,), bismuth ($^{212}$Bi, $^{213}$Bi), technetium ($^{99}$Tc), thallium $^{201}$Ti), gallium ($^{68}$Ga, $^{67}$Ga), palladium ($^{103}$Pd), molybdenum ($^{99}$Mo), xenon ($^{133}$Xe), fluorine ($^{18}$F), $^{153}$Sm, $^{177}$Lu, $^{159}$Gd, $^{149}$Pm, $^{140}$La, $^{175}$Yb, $^{166}$Ho, $^{90}$Y, $^{47}$Sc, $^{186}$Re, $^{188}$Re, $^{142}$Pr, $^{105}$Rh, $^{97}$Ru, $^{68}$Ge, $^{57}$Co, $^{65}$Zn, $^{85}$Sr, $^{32}$P, $^{153}$Gd, $^{169}$Yb, $^{51}$Cr, $^{54}$Mn, $^{75}$Se, $^{113}$Sn, $^{117}$Sn, $^{225}$Ac, $^{76}$Br, and 2. Diagnostic or Detection Agents In other preferred embodiments, the antibodies of the invention, or fragments or derivatives thereof, are conjugated to a diagnostic or detectable agent, marker or reporter which may be, for example, a biological molecule (e.g., a peptide or nucleotide), a small molecule, fluorophore, or radioisotope. Labeled antibodies can be useful for monitoring the development or progression of a hyperproliferative disorder or as part of a clinical testing procedure to determine the efficacy of a particular therapy including the disclosed antibodies (i.e. theragnostics) or to determine a future course of treatment. Such markers or reporters may also be useful in purifying the selected antibody, for use in antibody analytics (e.g., epitope binding or antibody binning), separating or isolating tumorigenic cells or in preclinical procedures or toxicology studies.

Such diagnosis, analysis and/or detection can be accomplished by coupling the antibody to detectable substances including, but not limited to, various enzymes comprising for example horseradish peroxidase, alkaline phosphatase, beta-galactosidase, or acetylcholinesterase; prosthetic groups, such as but not limited to streptavidinlbiotin and avidin/biotin; fluorescent materials, such as but not limited to, umbelliferone, fluorescein, fluorescein isothiocynate, rhodamine, dichlorotriazinylamine fluorescein, dansyl chloride or phycoerythrin; luminescent materials, such as but not limited to, luminol; bioluminescent materials, such as but not limited to, luciferase, luciferin, and aequorin; radioactive materials, such as but not limited to iodine ($^{131}$I, $^{125}$I, $^{123}$I, $^{121}$I,), carbon ($^{14}$C), sulfur ($^{35}$S), tritium ($^{3}$H), indium ($^{115}$In, $^{113}$In, $^{112}$In, $^{111}$In,), and technetium ($^{99}$Tc), thallium ($^{201}$Ti), gallium ($^{68}$Ga, $^{67}$Ga), palladium ($^{103}$Pd), molybdenum ($^{99}$Mo), xenon ($^{133}$Xe), fluorine ($^{18}$F), $^{153}$Sm, $^{177}$Lu, $^{159}$Gd, $^{149}$Pm, $^{140}$La, $^{175}$Yb, $^{166}$Ho, $^{90}$Y, $^{47}$Sc, $^{186}$Re, $^{188}$Re, $^{142}$Pr, $^{105}$Rh, $^{97}$Ru, $^{68}$Ge, $^{57}$Co, $^{65}$Zn, $^{85}$Sr, $^{32}$P, $^{153}$Gd, $^{169}$Yb, $^{51}$Cr, $^{54}$Mn, $^{75}$Se, $^{113}$Sn, and $^{117}$Tin; positron emitting metals using various positron emission tomographies, non-radioactive paramagnetic metal ions, and molecules that are radiolabeled or conjugated to specific radioisotopes. In such embodiments appropriate detection methodology is well known in the art and readily available from numerous commercial sources.

In other embodiments the antibodies or fragments thereof can be fused or conjugated to marker sequences or compounds, such as a peptide or fluorophore to facilitate purification or diagnostic or analytic procedures such as immunohistochemistry, bio-layer interferometry, surface plasmon resonance, flow cytometry, competitive ELISA, FACs, etc. In preferred embodiments, the marker comprises a histidine tag such as that provided by the pQE vector (Qiagen), among others, many of which are commercially available. Other peptide tags useful for purification include, but are not limited to, the hemagglutinin "HA" tag, which corresponds to an epitope derived from the influenza hemagglutinin protein (Wilson et al., 1984, Cell 37:767) and the "flag" tag (U.S. Pat. No. 4,703,004).

3. Biocompatible Modifiers

In selected embodiments antibodies of the invention may be conjugated to biocompatible modifiers that may be used to adjust, alter, improve or moderate antibody characteristics as desired. For example, antibodies or fusion constructs with increased in vivo half-lives can be generated by attaching relatively high molecular weight polymer molecules such as commercially available polyethylene glycol (PEG) or similar biocompatible polymers. PEG may be obtained in many different molecular weights and molecular configurations that can be selected to impart specific properties to the antibody (e.g. the half-life may be tailored). PEG can be attached to antibodies or antibody fragments or derivatives with or without a multifunctional linker either through site-specific conjugation of the PEG to the N- or C-terminus of said antibodies or antibody fragments or via epsilon-amino groups present on lysine residues. Linear or branched polymer derivatization that results in minimal loss of biological activity may be used. The degree of conjugation can be closely monitored by SDS-PAGE and mass spectrometry to ensure optimal conjugation of PEG molecules to antibody molecules. Unreacted PEG can be separated from antibody-PEG conjugates by, e.g., size exclusion or ion-exchange chromatography. In a similar manner, the disclosed antibodies can be conjugated to albumin in order to make the antibody or antibody fragment more stable in vivo or have a longer half-life in vivo. The techniques are well known in the art, see e.g., WO 93/15199, WO 93/15200, and WO 01/77137; and EP 0 413, 622.

4. Linker Compounds

Numerous linker compounds can be used to conjugate the antibodies of the invention to the relevant warhead. The linkers merely need to covalently bind with the reactive residue on the antibody (preferably a cysteine or lysine) and the selected drug compound. Accordingly, any linker that reacts with the selected antibody residue and may be used to provide the relatively stable antibody drug conjugates of the instant invention is compatible with the teachings herein.

Numerous compatible linkers can advantageously bind to reduced cysteines and lysines, which are nucleophilic. Conjugation reactions involving reduced cysteines and lysines include, but are not limited to, thiol-maleimide, thiol-halogeno (acyl halide), thiol-ene, thiol-yne, thiol-vinylsulfone, thiol-bisulfone, thiol-thiosulfonate, thiol-pyridyl disulfide and thiol-parafluoro reactions. Thiol-maleimide bioconjugation is one of the most widely used approaches due to its fast reaction rates and mild conjugation conditions. One issue with this approach is the possibility of the retro-Michael reaction and loss or transfer of the maleimido-linked payload from the antibody to other proteins in the plasma, such as, for example, human serum albumin. However, in preferred embodiments the use of selective reduction and site-specific antibodies as set forth herein in Examples 11 and 12 may be used to stabilize the antibody drug conjugate and reduce this undesired transfer. Thiol-acyl halide reactions provide bioconjugates that cannot undergo retro-Michael reaction and therefore are more stable. However, the thiol-halide reactions in general have slower reaction rates compared to maleimide-based conjugations and are thus not as efficient in providing undesired drug to antibody ratios. Thiol-pyridyl disulfide reaction is another popular bioconjugation route. The pyridyl disulfide undergoes fast exchange with free thiol resulting in the mixed disulfide and release of pyridine-2-thione. Mixed disulfides can be cleaved in the reductive cell environment releasing the payload. Other approaches gaining more attention in bioconjugation are thiol-vinylsulfone and thiol-bisulfone reactions, each of which are compatible with the teachings herein.

In preferred embodiments compatible linkers will confer stability on the ADCs in the extracellular environment, prevent aggregation of the ADC molecules and keep the ADC freely soluble in aqueous media and in a monomeric state. While the linkers are stable outside the target cell they are designed to be cleaved or degraded at some efficacious rate inside the cell. Accordingly an effective linker will: (i) maintain the specific binding properties of the antibody; (ii) allow intracellular delivery of the conjugate or drug moiety; (iii) remain stable and intact, i.e. not cleaved or degraded, until the conjugate has been delivered or transported to its targeted site; and (iv) maintain a cytotoxic, cell-killing effect or a cytostatic effect of the drug moiety (including, in some cases, any bystander effects). The stability of the ADC may be measured by standard analytical techniques such as HPLC/UPLC, mass spectroscopy, HPLC, and the separation/analysis techniques LC/MS and LC/MS/MS. As set forth above covalent attachment of the antibody and the drug moiety requires the linker to have two reactive functional groups, i.e. bivalency in a reactive sense. Bivalent linker reagents which are useful to attach two or more functional or biologically active moieties, such as MMAE and antibodies are known, and methods have been described to provide their resulting conjugates.

Linkers compatible with the present invention may broadly be classified as cleavable and non-cleavable linkers. Cleavable linkers, which may include acid-labile linkers, protease cleavable linkers and disulfide linkers, are internalized into the target cell and are cleaved in the endosomal-lysosomal pathway inside the cell. Release and activation of the cytotoxin relies on endosome/lysosome acidic compartments that facilitate cleavage of acid-labile chemical linkages such as hydrazone or oxime. If a lysosomal-specific protease cleavage site is engineered into the linker the cytotoxins will be released in proximity to their intracellular targets. Alternatively, linkers containing mixed disulfides provide an approach by which cytotoxic payloads are released intracellularly as they are selectively cleaved in the reducing environment of the cell, but not in the oxygen-rich environment in the bloodstream. By way of contrast, compatible non-cleavable linkers containing amide linked polyethyleneglycol or alkyl spacers liberate toxic payloads during lysosomal degradation of the ADC within the target cell. In some respects the selection of linker will depend on the particular drug used in the ADC, the particular indication and the antibody target.

Accordingly, certain embodiments of the invention comprise a linker that is cleavable by a cleaving agent that is present in the intracellular environment (e.g., within a lysosome or endosome or caveolae). The linker can be, for example, a peptidyl linker that is cleaved by an intracellular peptidase or protease enzyme, including, but not limited to, a lysosomal or endosomal protease. In some embodiments, the peptidyl linker is at least two amino acids long or at least three amino acids long. Cleaving agents can include cathepsins B and D and plasmin, each of which is known to hydrolyze dipeptide drug derivatives resulting in the release of active drug inside target cells. Exemplary peptidyl linkers that are cleavable by the thiol-dependent protease Cathepsin-B are peptides comprising Phe-Leu since cathepsin-B has been found to be highly expressed in cancerous tissue. Other examples of such linkers are described, for example, in U.S. Pat. No. 6,214,345. In a specific preferred embodiment, the peptidyl linker cleavable by an intracellular protease is a Val-Cit linker, a Val-Ala linker or a Phe-Lys linker such as is described in U.S. Pat. No. 6,214,345. One advantage of using intracellular proteolytic release of the therapeutic agent is that the agent is typically attenuated when conjugated and the serum stabilities of the conjugates are typically high.

In other embodiments, the cleavable linker is pH-sensitive. Typically, the pH-sensitive linker will be hydrolyzable under acidic conditions. For example, an acid-labile linker that is hydrolyzable in the lysosome (e.g., a hydrazone, oxime, semicarbazone, thiosemicarbazone, cis-aconitic amide, orthoester, acetal, ketal, or the like) can be used (See, e.g., U.S. Pat. Nos. 5,122,368; 5,824,805; 5,622,929). Such linkers are relatively stable under neutral pH conditions, such as those in the blood, but are unstable at below pH 5.5 or 5.0, the approximate pH of the lysosome.

In yet other embodiments, the linker is cleavable under reducing conditions (e.g., a disulfide linker). A variety of disulfide linkers are known in the art, including, for example, those that can be formed using SATA (N-succinimidyl-S-acetylthioacetate), SPDP (N-succinimidyl-3-(2-pyridyldithio)propionate), SPDB (N-succinimidyl-3-(2-pyridyldithio) butyrate) and SMPT (N-succinimidyl-oxycarbonyl-alpha-methyl-alpha-(2-pyridyl-dithio) toluene). In yet other specific embodiments, the linker is a malonate linker (Johnson et al., 1995, Anticancer Res. 15:1387-93), a maleimidobenzoyl linker (Lau et al., 1995, Bioorg-Med-Chem. 3(10):1299-1304), or a 3'-N-amide analog (Lau et al., 1995, Bioorg-Med-Chem. 3(10):1305-12).

In particularly preferred embodiments (set forth in U.S.P.N. 2011/0256157) compatible peptidyl linkers will comprise:

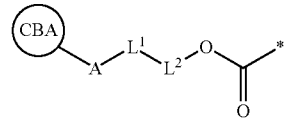

where the asterisk indicates the point of attachment to the drug, CBA is the anti-DLL3 antibody, $L^1$ is a linker, A is a connecting group (optionally comprising a spacer) connecting $L^1$ to a reactive residue on the antibody, $L^2$ is a covalent bond or together with —OC(=O)— forms a self-immolative linker, and $L^1$ or $L^2$ is a cleavable linker.

$L^1$ is preferably the cleavable linker, and may be referred to as a trigger for activation of the linker for cleavage.

The nature of $L^1$ and $L^2$, where present, can vary widely. These groups are chosen on the basis of their cleavage characteristics, which may be dictated by the conditions at the site to which the conjugate is delivered. Those linkers that are cleaved by the action of enzymes are preferred, although linkers that are cleavable by changes in pH (e.g. acid or base labile), temperature or upon irradiation (e.g. photolabile) may also be used. Linkers that are cleavable under reducing or oxidizing conditions may also find use in the present invention.

$L^1$ may comprise a contiguous sequence of amino acids. The amino acid sequence may be the target substrate for enzymatic cleavage, thereby allowing release of the drug.

In one embodiment, $L^1$ is cleavable by the action of an enzyme. In one embodiment, the enzyme is an esterase or a peptidase.

In one embodiment, $L^1$ comprises a dipeptide. The dipeptide may be represented as —NH—$X_1$—$X_2$—CO—, where —NH— and —CO— represent the N- and C-terminals of the amino acid groups $X_1$ and $X_2$ respectively. The amino acids in the dipeptide may be any combination of natural amino acids. Where the linker is a cathepsin labile linker, the dipeptide may be the site of action for cathepsin-mediated cleavage.

Additionally, for those amino acids groups having carboxyl or amino side chain functionality, for example Glu and Lys respectively, CO and NH may represent that side chain functionality.

In one embodiment, the group —$X_1$—$X_2$— in dipeptide, —NH—$X_1$—$X_2$—CO—, is selected from: -Phe-Lys-, -Val-Ala-, -Val-Lys-, -Ala-Lys-, -Val-Cit-, -Phe-Cit-, -Leu-Cit-, -Ile-Cit-, -Phe-Arg- and -Trp-Cit- where Cit is citrulline.

Preferably, the group —$X_1$—$X_2$— in dipeptide, —NH—$X_1$—$X_2$—CO—, is selected from: -Phe-Lys-, -Val-Ala-, -Val-Lys-, -Ala-Lys-, and -Val-Cit-.

Most preferably, the group —$X_1$—$X_2$— in dipeptide, —NH—$X_1$—$X_2$—CO—, is -Phe-Lys- or -Val-Ala-.

In one embodiment, $L^2$ is present and together with —C(=O)O— forms a self-immolative linker. In one embodiment, $L^2$ is a substrate for enzymatic activity, thereby allowing release of the drug.

In one embodiment, where $L^2$ is cleavable by the action of an enzyme and $L^2$ is present, the enzyme cleaves the bond between $L^2$ and $L^2$.

L¹ and L², where present, may be connected by a bond selected from: —C(=O)NH—, —C(=O)O—, —NHC (=O)—, —OC(=O)—, —OC(=O)O—, —NHC(=O) O—, —OC(=O)NH—, and —NHC(=O)NH— An amino group of L¹ that connects to L² may be the N-terminus of an amino acid or may be derived from an amino group of an amino acid side chain, for example a lysine amino acid side chain.

A carboxyl group of L¹ that connects to L² may be the C-terminus of an amino acid or may be derived from a carboxyl group of an amino acid side chain, for example a glutamic acid amino acid side chain.

A hydroxyl group of L¹ that connects to L² may be derived from a hydroxyl group of an amino acid side chain, for example a serine amino acid side chain.

The term "amino acid side chain" includes those groups found in: (i) naturally occurring amino acids such as alanine, arginine, asparagine, aspartic acid, cysteine, glutamine, glutamic acid, glycine, histidine, isoleucine, leucine, lysine, methionine, phenylalanine, proline, serine, threonine, tryptophan, tyrosine, and valine; (ii) minor amino acids such as ornithine and citrulline; (iii) unnatural amino acids, beta-amino acids, synthetic analogs and derivatives of naturally occurring amino acids; and (iv) all enantiomers, diastereomers, isomerically enriched, isotopically labelled (e.g. $^2$H, $^3$H, $^{14}$C, $^{15}$N), protected forms, and racemic mixtures thereof.

In one embodiment, —C(=O)O— and L² together form the group:

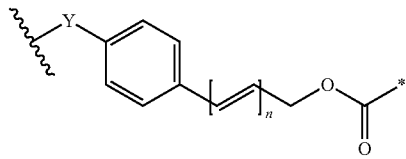

where the asterisk indicates the point of attachment to the drug or cytotoxic agent position, the wavy line indicates the point of attachment to the linker L¹, Y is —N(H)—, —O—, —C(=O)N(H)— or —C(=O)O—, and n is 0 to 3. The phenylene ring is optionally substituted with one, two or three substituents as described herein. In one embodiment, the phenylene group is optionally substituted with halo, NO₂, R or OR.

In one embodiment, Y is NH.

In one embodiment, n is 0 or 1. Preferably, n is 0.

Where Y is NH and n is 0, the self-immolative linker may be referred to as a p-aminobenzylcarbonyl linker (PABC).

In another particularly preferred embodiments the linker may include a self-immolative linker and the dipeptide together form the group —NH-Val-Ala-CO—NH-PABC-, which is illustrated below:

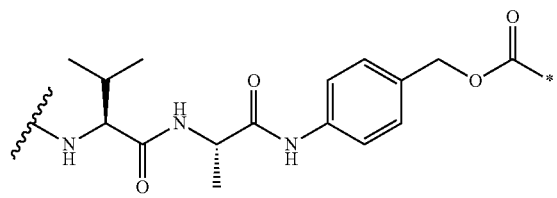 [SMILES: *N[C@H](C(=O)N[C@@H](C)C(=O)Nc1ccc(COC(*)=O)cc1)C(C)C]

where the asterisk indicates the point of attachment to the selected cytotoxic moiety, and the wavy line indicates the point of attachment to the remaining portion of the linker (e.g., the spacer-antibody binding segments) which may be conjugated to the antibody. Upon enzymatic cleavage of the dipeptide the self-immolative linker will allow for clean release of the protected compound (i.e., the cytotoxin) when a remote site is activated, proceeding along the lines shown below:

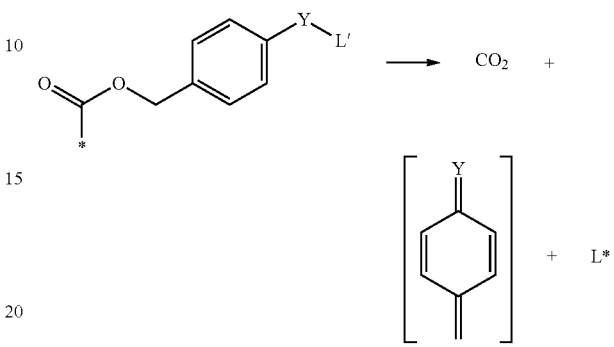

where L* is the activated form of the remaining portion of the linker comprising the now cleaved peptidyl unit. The clean release of the drug ensures they will maintain the desired toxic activity.

In one embodiment, A is a covalent bond. Thus, L¹ and the antibody are directly connected. For example, where L¹ comprises a contiguous amino acid sequence, the N-terminus of the sequence may connect directly to the antibody residue.

In another embodiment, A is a spacer group. Thus, L¹ and the antibody are indirectly connected.

L¹ and A may be connected by a bond selected from: —C(=O)NH—, —C(=O)O—, —NHC(=O)—, —OC (=O)—, —OC(=O)O—, —NHC(=O)O—, —OC(=O) NH—, and —NHC(=O)NH—.

As will be discussed in more detail below the drug linkers of the instant invention will preferably be linked to reactive thiol nucleophiles on cysteines, including free cysteines. To this end the cysteines of the antibodies may be made reactive for conjugation with linker reagents by treatment with various reducing agent such as DTT or TCEP or mild reducing agents as set forth herein. In other embodiments the drug linkers of the instant invention will preferably be linked to a lysine.

Preferably, the linker contains an electrophilic functional group for reaction with a nucleophilic functional group on the antibody. Nucleophilic groups on antibodies include, but are not limited to: (i) N-terminal amine groups, (ii) side chain amine groups, e.g. lysine, (iii) side chain thiol groups, e.g. cysteine, and (iv) sugar hydroxyl or amino groups where the antibody is glycosylated. Amine, thiol, and hydroxyl groups are nucleophilic and capable of reacting to form covalent bonds with electrophilic groups on linker moieties and linker reagents including: (i) maleimide groups (ii) activated disulfides, (iii) active esters such as NHS (N-hydroxysuccinimide) esters, HOBt (N-hydroxybenzotriazole) esters, haloformates, and acid halides; (iv) alkyl and benzyl halides such as haloacetamides; and (v) aldehydes, ketones, carboxyl, and, some of which are exemplified as follows:

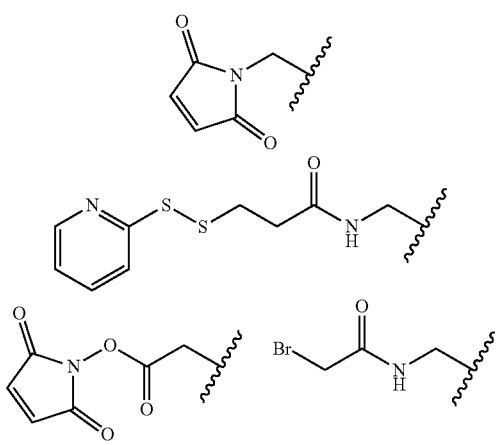

In particularly preferred embodiments the connection between a site-specific antibody and the drug-linker moiety is through a thiol residue of a free cysteine of the site specific antibody and a terminal maleimide group of present on the linker. In such embodiments, the connection between the antibody and the drug-linker is:

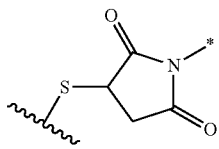 [SMILES: *SC1CC(=O)N(*)C1=O]

where the asterisk indicates the point of attachment to the remaining portion of drug-linker and the wavy line indicates the point of attachment to the remaining portion of the antibody. In this embodiment, the S atom is preferably derived from a site-specific free cysteine. With regard to other compatible linkers the binding moiety comprises a terminal iodoacetamide that may be reacted with activated residues to provide the desired conjugate. In any event one skilled in the art could readily conjugate each of the disclosed drug-linker compounds with a compatible anti-DLL3 site-specific antibody in view of the instant disclosure.

5. Conjugation

A number of well-known different reactions may be used to attach the drug moiety and/or linker to the selected antibody. For example, various reactions exploiting sulfhydryl groups of cysteines may be employed to conjugate the desired moiety. Particularly preferred embodiments will comprise conjugation of antibodies comprising one or more free cysteines as discussed in detail below. In other embodiments ADCs of the instant invention may be generated through conjugation of drugs to solvent-exposed amino groups of lysine residues present in the selected antibody. Still other embodiments comprise activation of the N-terminal threonine and serine residues which may then be used to attach the disclosed payloads to the antibody. The selected conjugation methodology will preferably be tailored to optimize the number of drugs attached to the antibody and provide a relatively high therapeutic index.

Various methods are known in the art for conjugating a therapeutic compound to a cysteine residue and will be apparent to the skilled artisan. Under basic conditions the cysteine residues will be deprotonated to generate a thiolate nucleophile which may be reacted with soft electrophiles, such as maleimides and iodoacetamides. Generally reagents for such conjugations may react directly with a cysteine thiol of a cysteine to form the conjugated protein or with a linker-drug to form a linker-drug intermediate. In the case of a linker, several routes, employing organic chemistry reactions, conditions, and reagents are known to those skilled in the art, including: (1) reaction of a cysteine group of the protein of the invention with a linker reagent, to form a protein-linker intermediate, via a covalent bond, followed by reaction with an activated compound; and (2) reaction of a nucleophilic group of a compound with a linker reagent, to form a drug-linker intermediate, via a covalent bond, followed by reaction with a cysteine group of a protein of the invention. As will be apparent to the skilled artisan from the foregoing, bifunctional linkers are useful in the present invention. For example, the bifunctional linker may comprise a thiol modification group for covalent linkage to the cysteine residue(s) and at least one attachment moiety (e.g., a second thiol modification moiety) for covalent or non-covalent linkage to the compound.

Prior to conjugation, antibodies may be made reactive for conjugation with linker reagents by treatment with a reducing agent such as dithiothreitol (DTT) or (tris(2-carboxyethyl)phosphine (TCEP). In other embodiments additional nucleophilic groups can be introduced into antibodies through the reaction of lysines with reagents, including but not limited to, 2-iminothiolane (Traut's reagent), SATA, SATP or SAT(PEG)4, resulting in conversion of an amine into a thiol.

With regard to such conjugations cysteine thiol or lysine amino groups are nucleophilic and capable of reacting to form covalent bonds with electrophilic groups on linker reagents or compound-linker intermediates or drugs including: (i) active esters such as NHS esters, HOBt esters, haloformates, and acid halides; (ii) alkyl and benzyl halides, such as haloacetamides; (iii) aldehydes, ketones, carboxyl, and maleimide groups; and (iv) disulfides, including pyridyl disulfides, via sulfide exchange. Nucleophilic groups on a compound or linker include, but are not limited to amine, thiol, hydroxyl, hydrazide, oxime, hydrazine, thiosemicarbazone, hydrazine carboxylate, and arylhydrazide groups capable of reacting to form covalent bonds with electrophilic groups on linker moieties and linker reagents.

Preferred labeling reagents include maleimide, haloacetyl, iodoacetamide succinimidyl ester, isothiocyanate, sulfonyl chloride, 2,6-dichlorotriazinyl, pentafluorophenyl ester, and phosphoramidite, although other functional groups can also be used. In certain embodiments methods include, for example, the use of maleimides, iodoacetimides or haloacetyl/alkyl halides, aziridne, acryloyl derivatives to react with the thiol of a cysteine to produce a thioether that is reactive with a compound. Disulphide exchange of a free thiol with an activated piridyldisulphide is also useful for producing a conjugate (e.g., use of 5-thio-2-nitrobenzoic (TNB) acid). Preferably, a maleimide is used.

As indicated above, lysine may also be used as a reactive residue to effect conjugation as set forth herein. The nucleophilic lysine residue is commonly targeted through amine-reactive succinimidylesters. To obtain an optimal number of deprotonated lysine residues, the pH of the aqueous solution must be below the pKa of the lysine ammonium group, which is around 10.5, so the typical pH of the reaction is about 8 and 9. The common reagent for the coupling reaction is NHS-ester which reacts with nucleophilic lysine through a lysine acylation mechanism. Other compatible reagents that undergo similar reactions comprise isocyanates and isothiocyanates which also may be used in conjunction with the teachings herein to provide ADCs. Once the lysines have been activated, many of the aforementioned linking groups may be used to covalently bind the warhead to the antibody.

Methods are also known in the art for conjugating a compound to a threonine or serine residue (preferably a N-terminal residue). For example methods have been described in which carbonyl precursors are derived from the 1,2-aminoalcohols of serine or threonine, which can be selectively and rapidly converted to aldehyde form by periodate oxidation. Reaction of the aldehyde with a 1,2-aminothiol of cysteine in a compound to be attached to a protein of the invention forms a stable thiazolidine product. This method is particularly useful for labeling proteins at N-terminal serine or threonine residues.

In particularly preferred embodiments reactive thiol groups may be introduced into the selected antibody (or fragment thereof) by introducing one, two, three, four, or more free cysteine residues (e.g., preparing antibodies comprising one or more free non-native cysteine amino acid residues). Such site-specific antibodies or engineered antibodies, allow for conjugate preparations that exhibit enhanced stability and substantial homogeneity due, at least in part, to the provision of engineered free cysteine site(s) and/or the novel conjugation procedures set forth herein. Unlike conventional conjugation methodology that fully or partially reduces each of the intrachain or interchain antibody disulfide bonds to provide conjugation sites (and is fully compatible with the instant invention), the present invention additionally provides for the selective reduction of certain prepared free cysteine sites and direction of the drug-linker to the same. The conjugation specificity promoted by the engineered sites and the selective reduction allows for a high percentage of site directed conjugation at the desired positions. Significantly some of these conjugation sites, such as those present in the terminal region of the light chain constant region, are typically difficult to conjugate effectively as they tend to cross-react with other free cysteines. However, through molecular engineering and selective reduction of the resulting free cysteines, efficient conjugation rates may be obtained which considerably reduces unwanted high-DAR contaminants and non-specific toxicity. More generally the engineered constructs and disclosed novel conjugation methods comprising selective reduction provide ADC preparations having improved pharmacokinetics and/or pharmacodynamics and, potentially, an improved therapeutic index.

The site-specific constructs present free cysteine(s), which when reduced comprise thiol groups that are nucleophilic and capable of reacting to form covalent bonds with electrophilic groups on linker moieties such as those disclosed above. Preferred antibodies of the instant invention will have reducible unpaired interchain or intrachain cysteines, i.e. cysteines providing such nucleophilic groups. Thus, in certain embodiments the reaction of free sulfhydryl groups of the reduced unpaired cysteines and the terminal maleimido or haloacetamide groups of the disclosed drug-linkers will provide the desired conjugation. In such cases the free cysteines of the antibodies may be made reactive for conjugation with linker reagents by treatment with a reducing agent such as dithiothreitol (DTT) or (tris (2-carboxyethyl)phosphine (TCEP). Each free cysteine will thus present, theoretically, a reactive thiol nucleophile. While such reagents are compatible. Conjugation of the site-specific antibodies may be effected using various reactions, conditions and reagents known to those skilled in the art.

In addition it has been found that the free cysteines of engineered antibodies may be selectively reduced to provide enhanced site-directed conjugation and a reduction in unwanted, potentially toxic contaminants. More specifically "stabilizing agents" such as arginine have been found to modulate intra- and inter-molecular interactions in proteins and may be used, in conjunction with selected reducing agents (preferably relatively mild), to selectively reduce the free cysteines and to facilitate site-specific conjugation as set forth herein. As used herein the terms "selective reduction" or "selectively reducing" may be used interchangeably and shall mean the reduction of free cysteine(s) without substantially disrupting native disulfide bonds present in the engineered antibody. In selected embodiments this may be affected by certain reducing agents. In other preferred embodiments selective reduction of an engineered construct will comprise the use of stabilization agents in combination with reducing agents (including mild reducing agents). The term "selective conjugation" shall mean the conjugation of an engineered antibody that has been selectively reduced with a cytotoxin as described herein. In this respect the use of such stabilizing agents in combination with selected reducing agents can markedly improve the efficiency of site-specific conjugation as determined by extent of conjugation on the heavy and light antibody chains and DAR distribution of the preparation.

While not wishing to be bound by any particular theory, such stabilizing agents may act to modulate the electrostatic microenvironment and/or modulate conformational changes at the desired conjugation site, thereby allowing relatively mild reducing agents (which do not materially reduce intact native disulfide bonds) to facilitate conjugation at the desired free cysteine site. Such agents (e.g., certain amino acids) are known to form salt bridges (via hydrogen bonding and electrostatic interactions) and may modulate protein-protein interactions in such a way as to impart a stabilizing effect that may cause favorable conformation changes and/or may reduce unfavorable protein-protein interactions. Moreover, such agents may act to inhibit the formation of undesired intramolecular (and intermolecular) cysteine-cysteine bonds after reduction thus facilitating the desired conjugation reaction wherein the engineered site-specific cysteine is bound to the drug (preferably via a linker). Since selective reduction conditions do not provide for the significant reduction of intact native disulfide bonds, the subsequent conjugation reaction is naturally driven to the relatively few reactive thiols on the free cysteines (e.g., preferably 2 free thiols per antibody). As previously alluded to this considerably reduces the levels of non-specific conjugation and corresponding impurities in conjugate preparations fabricated as set forth herein.

In selected embodiments stabilizing agents compatible with the present invention will generally comprise compounds with at least one moiety having a basic pKa. In certain embodiments the moiety will comprise a primary amine while in other preferred embodiments the amine moiety will comprise a secondary amine. In still other preferred embodiments the amine moiety will comprise a tertiary amine or a guanidinium group. In other selected embodiments the amine moiety will comprise an amino acid while in other compatible embodiments the amine moiety will comprise an amino acid side chain. In yet other embodiments the amine moiety will comprise a proteinogenic amino acid. In still other embodiments the amine moiety comprises a non-proteinogenic amino acid. In particularly preferred embodiments, compatible stabilizing agents may comprise arginine, lysine, proline and cysteine. In addition compatible stabilizing agents may include guanidine and nitrogen containing heterocycles with basic pKa.

In certain embodiments compatible stabilizing agents comprise compounds with at least one amine moiety having a pKa of greater than about 7.5, in other embodiments the subject amine moiety will have a pKa of greater than about 8.0, in yet other embodiments the amine moiety will have a pKa greater than about 8.5 and in still other embodiments the stabilizing agent will comprise an amine moiety having a pKa of greater than about 9.0. Other preferred embodiments will comprise stabilizing agents where the amine moiety will have a pKa of greater than about 9.5 while certain other embodiments will comprise stabilizing agents exhibiting at least one amine moiety having a pKa of greater than about 10.0. In still other preferred embodiments the stabilizing agent will comprise a compound having the amine moiety with a pKa of greater than about 10.5, in other embodiments the stabilizing agent will comprise a compound having a amine moiety with a pKa greater than about 11.0, while in still other embodiments the stabilizing agent will comprise a amine moiety with a pKa greater than about 11.5. In yet other embodiments the stabilizing agent will comprise a compound having an amine moiety with a pKa greater than about 12.0, while in still other embodiments the stabilizing agent will comprise an amine moiety with a pKa greater than about 12.5. Relevant pKa's may readily be calculated or determined using standard techniques and used to determine the applicability of using a selected compound as a stabilizing agent.

The disclosed stabilizing agents are shown to be particularly effective at targeting conjugation to free site-specific cysteines when combined with certain reducing agents. For the purposes of the instant invention, compatible reducing agents may include any compound that produces a reduced free site-specific cysteine for conjugation without significantly disrupting the engineered antibody native disulfide bonds. Under such conditions, provided by the combination of selected stabilizing and reducing agents, the activated drug linker is largely limited to binding to the desired free site-specific cysteine site. Relatively mild reducing agents or reducing agents used at relatively low concentrations to provide mild conditions are particularly preferred. As used herein the terms "mild reducing agent" or "mild reducing conditions" shall be held to mean any agent or state brought about by a reducing agent (optionally in the presence of stabilizing agents) that provides thiols at the free cysteine site(s) without substantially disrupting native disulfide bonds present in the engineered antibody. That is, mild reducing agents or conditions are able to effectively reduce free cysteine(s) (provide a thiol) without significantly disrupting the protein's native disulfide bonds. The desired reducing conditions may be provided by a number of sulfhydryl-based compounds that establish the appropriate environment for selective conjugation. In preferred embodiments mild reducing agents may comprise compounds having one or more free thiols while in particularly preferred embodiments mild reducing agents will comprise compounds having a single free thiol. Non-limiting examples of reducing agents compatible with the instant invention comprise glutathione, n-acetyl cysteine, cysteine, 2-aminoethane-1-thiol and 2-hydroxyethane-1-thiol.

Selective reduction process set forth above is particularly effective at targeted conjugation to the free cysteine. In this respect the extent of conjugation to the desired target site (defined here as "conjugation efficiency") in site-specific antibodies may be determined by various art-accepted techniques. The efficiency of the site-specific conjugation of a drug to an antibody may be determined by assessing the percentage of conjugation on the target conjugation site (in this invention the free cysteine on the c-terminus of the light chain) relative to all other conjugated sites. In certain embodiments, the method herein provides for efficiently conjugating a drug to an antibody comprising free cysteines. In some embodiments, the conjugation efficiency is at least 5%, at least 10%, at least 15%, at least 20%, at least 25%, at least 30%, at least 35%, at least 40%, at least 45%, at least 50%, at least 55%, at least 60%, at least 70%, at least 75%, at least 80%, at least 85%, at least 90%, at least 95%, at least 98% or more as measured by the percentage of target conjugation relative to all other conjugation sites.

It will further be appreciated that engineered antibodies capable of conjugation may contain free cysteine residues that comprise sulfhydryl groups that are blocked or capped as the antibody is produced or stored. Such caps include small molecules, proteins, peptides, ions and other materials that interact with the sulfhydryl group and prevent or inhibit conjugate formation. In some cases the unconjugated engineered antibody may comprise free cysteines that bind other free cysteines on the same or different antibodies. As discussed herein such cross-reactivity may lead to various contaminants during the fabrication procedure. In some embodiments, the engineered antibodies may require uncapping prior to a conjugation reaction. In specific embodiments, antibodies herein are uncapped and display a free sulfhydryl group capable of conjugation. In specific embodiments, antibodies herein are subjected to an uncapping reaction that does not disturb or rearrange the naturally occurring disulfide bonds. In most cases the uncapping reactions will occur during the normal reduction reactions (reduction or selective reduction).

6. DAR Distribution and Purification

One of the advantages of conjugation with site specific antibodies of the present invention is the ability to generate relatively homogeneous ADC preparations comprising a narrow DAR distribution. In this regard the disclosed constructs and/or selective conjugation provides for homogeneity of the ADC species within a sample in terms of the stoichiometric ratio between the drug and the engineered antibody. As briefly discussed above the term "drug to antibody ratio" or "DAR" refers to the molar ratio of drug to antibody. In some embodiments a conjugate preparation may be substantially homogeneous with respect to its DAR distribution, meaning that within the preparation is a predominant species of site-specific ADC with a particular DAR (e.g., a DAR of 2 or 4) that is also uniform with respect to the site of loading (i.e., on the free cysteines). In certain embodiments of the invention it is possible to achieve the desired homogeneity through the use of site-specific antibodies and/or selective reduction and conjugation. In other preferred embodiments the desired homogeneity may be achieved through the use of site-specific constructs in combination with selective reduction. In yet other particularly preferred embodiments the preparations may be further purified using analytical or preparative chromatography techniques. In each of these embodiments the homogeneity of the ADC sample can be analyzed using various techniques known in the art including but not limited to mass spectrometry, HPLC (e.g. size exclusion HPLC, RP-HPLC, HIC-HPLC etc.) or capillary electrophoresis.

With regard to the purification of ADC preparations standard pharmaceutical preparative methods may be employed to obtain the desired purity. As discussed herein liquid chromatography methods such as reverse phase (RP) and hydrophobic interaction chromatography (HIC) may separate compounds in the mixture by drug loading value. In some cases, ion-exchange (IEC) or mixed-mode chromatography (MMC) may also be used to isolate species with a specific drug load.

The disclosed ADCs and preparations thereof may comprise drug and antibody moieties in various stoichiometric molar ratios depending on the configuration of the antibody and, at least in part, on the method used to effect conjugation. In certain embodiments the drug loading per ADC may comprise from 1-20 warheads (i.e., n is 1-20). Other selected embodiments may comprise ADCs with a drug loading of from 1 to 15 warheads. In still other embodiments the ADCs may comprise from 1-12 warheads or, more preferably, from 1-10 warheads. In certain preferred embodiments the ADCs will comprise from 1 to 8 warheads.

While theoretical drug loading may be relatively high, practical limitations such as free cysteine cross reactivity and warhead hydrophobicity tend to limit the generation of homogeneous preparations comprising such DAR due to aggregates and other contaminants. That is, higher drug loading, e.g. >6, may cause aggregation, insolubility, toxicity, or loss of cellular permeability of certain antibody-drug conjugates. In view of such concerns practical drug loading provided by the instant invention preferably ranges from 1 to 8 drugs per conjugate, i.e. where 1, 2, 3, 4, 5, 6, 7, or 8 drugs are covalently attached to each antibody (e.g., for IgG1, other antibodies may have different loading capacity depending the number of disulfide bonds). Preferably the DAR of compositions of the instant invention will be approximately 2, 4 or 6 and in particularly preferred embodiments the DAR will comprise approximately 2.

Despite the relatively high level of homogeneity provided by the instant invention the disclosed compositions actually comprise a mixture of conjugates with a range of drugs compounds, from 1 to 8 (in the case of a IgG1). As such, the disclosed ADC compositions include mixtures of conjugates where most of the constituent antibodies are covalently linked to one or more drug moieties and (despite the conjugate specificity of selective reduction) where the drug moieties may be attached to the antibody by various thiol groups. That is, following conjugation ADC compositions of the invention will comprise a mixture of conjugates with different drug loads (e.g., from 1 to 8 drugs per IgG1 antibody) at various concentrations (along with certain reaction contaminants primarily caused by free cysteine cross reactivity). Using selective reduction and post-fabrication purification the conjugate compositions may be driven to the point where they largely contain a single predominant desired ADC species (e.g., with a drug loading of 2) with relatively low levels of other ADC species (e.g., with a drug loading of 1, 4, 6, etc.). The average DAR value represents the weighted average of drug loading for the composition as a whole (i.e., all the ADC species taken together). Due to inherent uncertainty in the quantification methodology employed and the difficulty in completely removing the non-predominant ADC species in a commercial setting, acceptable DAR values or specifications are often presented as an average, a range or distribution (i.e., an average DAR of 2+/−0.5). Preferably compositions comprising a measured average DAR within the range (i.e., 1.5 to 2.5) would be used in a pharmaceutical setting.

Thus, in certain preferred embodiments the present invention will comprise compositions having an average DAR of 1, 2, 3, 4, 5, 6, 7 or 8 each +/−0.5. In other preferred embodiments the present invention will comprise an average DAR of 2, 4, 6 or 8+/−0.5. Finally, in selected preferred embodiments the present invention will comprise an average DAR of 2+/−0.5. The range or deviation may be less than 0.4 in certain preferred embodiments. Thus, in other embodiments the compositions will comprise an average DAR of 1, 2, 3, 4, 5, 6, 7 or 8 each +/−0.3, an average DAR of 2, 4, 6 or 8+/−0.3, even more preferably an average DAR of 2 or 4+/−0.3 or even an average DAR of 2+/−0.3. In other embodiments IgG1 conjugate compositions will preferably comprise a composition with an average DAR of 1, 2, 3, 4, 5, 6, 7 or 8 each +/−0.4 and relatively low levels (i.e., less than 30%) of non-predominant ADC species. In other preferred embodiments the ADC composition will comprise an average DAR of 2, 4, 6 or 8 each +/−0.4 with relatively low levels (<30%) of non-predominant ADC species. In particularly preferred embodiments the ADC composition will comprise an average DAR of 2+/−0.4 with relatively low levels (<30%) of non-predominant ADC species. In yet other embodiments the predominant ADC species (e.g., DAR of 2) will be present at a concentration of greater than 65%, at a concentration of greater than 70%, at a concentration of greater than 75%, at a concentration of greater that 80%, at a concentration of greater than 85%, at a concentration of greater than 90%, at a concentration of greater than 93%, at a concentration of greater than 95% or even at a concentration of greater than 97% when measured against other DAR species.

As detailed in the Examples below the distribution of drugs per antibody in preparations of ADC from conjugation reactions may be characterized by conventional means such as UV-Vis spectrophotometry, reverse phase HPLC, HIC, mass spectroscopy, ELISA, and electrophoresis. The quantitative distribution of ADC in terms of drugs per antibody may also be determined. By ELISA, the averaged value of the drugs per antibody in a particular preparation of ADC may be determined. However, the distribution of drug per antibody values is not discernible by the antibody-antigen binding and detection limitation of ELISA. Also, ELISA assay for detection of antibody-drug conjugates does not determine where the drug moieties are attached to the antibody, such as the heavy chain or light chain fragments, or the particular amino acid residues.

X. Articles of Manufacture

The invention includes pharmaceutical packs and kits comprising one or more containers, wherein a container can comprise one or more doses of an antibody or ADC of the invention. In certain embodiments, the pack or kit contains a unit dosage, meaning a predetermined amount of a composition comprising, for example, an antibody or ADC of the invention, with or without one or more additional agents and optionally, one or more anti-cancer agents.

The kit of the invention will generally contain in a suitable container a pharmaceutically acceptable formulation of the antibody or ADC of the invention and, optionally, one or more anti-cancer agents in the same or different containers. The kits may also contain other pharmaceutically acceptable formulations or devices, either for diagnosis or combination therapy. Examples of diagnostic devices or instruments include those that can be used to detect, monitor, quantify or profile cells or markers associated with proliferative disorders (for a full list of such markers, see above). In particularly preferred embodiments the devices may be used to detect, monitor and/or quantify circulating tumor cells either in vivo or in vitro (see, for example, WO 2012/0128801). In still other preferred embodiments the circulating tumor cells may comprise tumorigenic cells. The kits contemplated by the invention can also contain appropriate reagents to combine the antibody or ADC of the invention with an anti-cancer agent or diagnostic agent (e.g., see U.S. Pat. No. 7,422,739).

When the components of the kit are provided in one or more liquid solutions, the liquid solution can be non-aqueous, however, an aqueous solution is preferred, with a sterile aqueous solution being particularly preferred. The formulation in the kit can also be provided as dried powder(s) or in lyophilized form that can be reconstituted upon addition of an appropriate liquid. The liquid used for reconstitution can be contained in a separate container. Such liquids can comprise sterile, pharmaceutically acceptable buffer(s) or other diluent(s) such as bacteriostatic water for injection, phosphate-buffered saline, Ringer's solution or dextrose solution. Where the kit comprises the antibody or ADC of the invention in combination with additional therapeutics or agents, the solution may be pre-mixed, either in a molar equivalent combination, or with one component in excess of the other. Alternatively, the antibody or ADC of the invention and any optional anti-cancer agent or other agent can be maintained separately within distinct containers prior to administration to a patient.

The kit can comprise one or multiple containers and a label or package insert in, on or associated with the container(s), indicating that the enclosed composition is used for diagnosing or treating the disease condition of choice. Suitable containers include, for example, bottles, vials, syringes, etc. The containers can be formed from a variety of materials such as glass or plastic. The container(s) can comprise a sterile access port, for example, the container may be an intravenous solution bag or a vial having a stopper that can be pierced by a hypodermic injection needle.

In some embodiments the kit can contain a means by which to administer the antibody and any optional components to a patient, e.g., one or more needles or syringes (pre-filled or empty), an eye dropper, pipette, or other such like apparatus, from which the formulation may be injected or introduced into the subject or applied to a diseased area of the body. The kits of the invention will also typically include a means for containing the vials, or such like, and other components in close confinement for commercial sale, such as, e.g., blow-molded plastic containers into which the desired vials and other apparatus are placed and retained.

XI. Miscellaneous

Unless otherwise defined herein, scientific and technical terms used in connection with the invention shall have the meanings that are commonly understood by those of ordinary skill in the art. Further, unless otherwise required by context, singular terms shall include pluralities and plural terms shall include the singular. In addition, ranges provided in the specification and appended claims include both end points and all points between the end points. Therefore, a range of 2.0 to 3.0 includes 2.0, 3.0, and all points between 2.0 and 3.0.

Generally, techniques of cell and tissue culture, molecular biology, immunology, microbiology, genetics and chemistry described herein are those well known and commonly used in the art. The nomenclature used herein, in association with such techniques, is also commonly used in the art. The methods and techniques of the invention are generally performed according to conventional methods well known in the art and as described in various references that are cited throughout the present specification unless otherwise indicated.

XII. References

The complete disclosure of all patents, patent applications, and publications, and electronically available material (including, for example, nucleotide sequence submissions in, e.g., GenBank and RefSeq, and amino acid sequence submissions in, e.g., SwissProt, PIR, PRF, PBD, and translations from annotated coding regions in GenBank and RefSeq) cited herein are incorporated by reference, regardless of whether the phrase "incorporated by reference" is or is not used in relation to the particular reference. The foregoing detailed description and the examples that follow have been given for clarity of understanding only. No unnecessary limitations are to be understood therefrom. The invention is not limited to the exact details shown and described. Variations obvious to one skilled in the art are included in the invention defined by the claims. Any section headings used herein are for organizational purposes only and are not to be construed as limiting the subject matter described.

XIII. Sequence Listing Summary

Appended to the instant application is a sequence listing comprising a number of nucleic acid and amino acid sequences as summarized in Table 2 below.

TABLE 2

| SEQ ID NO. | Description |
|---|---|
| 1 | DLL3 isoform 1 protein |
| 2 | DLL3 isoform 2 protein |
| 3 | Epitope SC16.23 protein |
| 4 | Epitope SC16.34 & SC 16.56 protein |
| 5 | Kappa light chain constant region protein |
| 6 | IgG1 heavy chain constant region protein |
| 7 | C220S IgG1 heavy constant region protein |
| 8 | C220Δ IgG1 heavy constant region protein |
| 9 | C214Δ Kappa light chain constant region protein |
| 10 | C214S Kappa light chain constant region protein |
| 11 | Lambda light chain constant region protein |
| 12 | C214Δ Lambda light chain constant region protein |
| 13 | C214S Lambda light chain constant region protein |
| 14 | SC16.56 ss1 and ss2 full length light chain protein |
| 15 | SC16.56 ss3 and ss4 full length heavy chain protein |
| 16 | SC16.56 ss1 full length heavy chain protein |
| 17 | SC16.56 ss2 full length heavy chain protein |
| 18 | SC16.56 ss3 full length light chain protein |
| 19 | SC16.56 ss4 full length light chain protein |
| 20 | SC16.3 VL DNA (aligned with encoded protein) |
| 21 | SC16.3 VL protein |
| 22 | SC16.3 VH DNA (aligned with encoded protein) |
| 23 | SC16.3 VH protein |
| 24-387 | Additional murine clones as in SEQ ID NOs: 20-23 |
| 388-407 | Humanized clones as in SEQ ID NOs: 20-23 |
| 408, 409, 410 | hSC16.13 CDRL1, CDRL2, CDRL3 |
| 411, 412, 413 | hSC16.13 CDRH1, CDRH2, CDRH3 |
| 414, 415, 416 | hSC16.15 CDRL1, CDRL2, CDRL3 |
| 417, 418, 419 | hSC16.15 CDRH1, CDRH2, CDRH3 |
| 420, 421, 422 | hSC16.25 CDRL1, CDRL2, CDRL3 |
| 423, 424, 425 | hSC16.25 CDRH1, CDRH2, CDRH3 |
| 426, 427, 428 | hSC16.34 CDRL1, CDRL2, CDRL3 |
| 429, 430, 431 | hSC16.34 CDRH1, CDRH2, CDRH3 |
| 432, 433, 434 | hSC16.56 CDRL1, CDRL2, CDRL3 |
| 435, 436, 437 | hSC16.56 CDRH1, CDRH2, CDRH3 |

I. EXAMPLES

The invention, thus generally described above, will be understood more readily by reference to the following examples, which are provided by way of illustration and are not intended to be limiting of the instant invention. The examples are not intended to represent that the experiments below are all or the only experiments performed. Unless indicated otherwise, parts are parts by weight, molecular weight is weight average molecular weight, temperature is in degrees Centigrade, and pressure is at or near atmospheric.

PDX tumor cell types are denoted by an abbreviation followed by a number, which indicates the particular tumor cell line. The passage number of the tested sample is indicated by p0-p# appended to the sample designation where p0 is indicative of an unpassaged sample obtained directly from a patient tumor and p# is indicative of the number of times the tumor has been passaged through a mouse prior to testing. As used herein, the abbreviations of the tumor types and subtypes are shown in TABLE 3 as follows:

TABLE 3

| Tumor Type | Abbreviation | Tumor subtype | Abbreviation |
|---|---|---|---|
| Breast | BR | | |
| | | estrogen receptor positive and/or progesterone receptor positive | BR-ERPR |
| | | ERBB2/Neu positive | BR-ERBB2/Neu |
| | | HER2 positive | BR-HER2 |
| | | triple-negative | TNBC |
| | | claudin subtype of triple-negative | TNBC-CL |
| Colorectal | CR | | |
| endometrial | EM | | |
| Gastric | GA | | |
| | | diffuse adenocarcinoma | GA-Ad-Dif/Muc |
| | | intestinal adenocarcinoma | GA-Ad-Int |
| | | stromal tumors | GA-GIST |
| glioblastoma | GB | | |
| head and neck | HN | | |
| Kidney | KDY | | |
| | | clear renal cell carcinoma | KDY-CC |
| | | papillary renal cell carcinoma | KDY-PAP |
| | | transitional cell or urothelial carcinoma | KDY-URO |
| | | unknown | KDY-UNK |
| Liver | LIV | | |
| | | hepatocellular carcinoma | LIV-HCC |
| | | cholangiocarcinoma | LIV-CHOL |
| Lymphoma | LN | | |
| Lung | LU | | |
| | | adenocarcinoma | LU-Ad |
| | | carcinoid | LU-CAR |
| | | large cell neuroendocrine | LU-LCC |
| | | non-small cell | NSCLC |
| | | squamous cell | LU-SCC |
| | | small cell | SCLC |
| | | spindle cell | LU-SPC |
| Ovarian | OV | | |
| | | clear cell | OV-CC |
| | | endometroid | OV-END |
| | | mixed subtype | OV-MIX |
| | | malignant mixed mesodermal | OV-MMMT |
| | | mucinous | OV-MUC |
| | | neuroendocrine | OV-NET |
| | | papillary serous | OV-PS |
| | | serous | OV-S |
| | | small cell | OV-SC |
| | | transitional cell carcinoma | OV-TCC |
| Pancreatic | PA | | |
| | | acinar cell carcinoma | PA-ACC |
| | | duodenal carcinoma | PA-DC |
| | | mucinous adenocarcinoma | PA-MAD |
| | | neuroendocrine | PA-NET |
| | | adenocarcinoma | PA-PAC |
| | | adenocarcinoma exocrine type | PA-PACe |
| | | ductal adenocarcinoma | PA-PDAC |
| | | ampullary adenocarcinoma | PA-AAC |
| Prostate | PR | | |
| Skin | SK | | |
| | | melanoma | MEL |
| | | squamous cell carcinomas | SK-SCC |
| | | uveal melanoma | UVM |

Example 1

Identification of DLL3 Expression in Melanoma Using Whole Transcriptome Sequencing To characterize the cellular heterogeneity of solid tumors as they exist in cancer patients and identify clinically relevant therapeutic targets, a large PDX tumor bank was developed and maintained using art recognized techniques. The PDX tumor bank, comprising a large number of discrete tumor cell lines, was propagated in immunocompromised mice through multiple passages of tumor cells originally obtained from cancer patients afflicted by a variety of solid tumor malignancies including melanoma (MEL). Low passage PDX tumors are representative of tumors in their native environments and provide clinically relevant insight into underlying mechanisms driving tumor growth and resistance to current therapies.

In order to perform whole transcriptome analysis, MEL PDX tumors (e.g. MEL3 and MEL13) were resected from mice after they reached 800-2,000 mm³. Resected PDX tumors were dissociated into single cell suspensions using art-recognized enzymatic digestion techniques (see, for example, U.S.P.N. 2007/0292414). In some cases where murine cell content was >5%, the PDX tumor samples were incubated with biotinylated anti-mouse CD45 and H-2K$^d$ antibodies and streptavidin-coated ferrous beads to deplete mouse cells. Following depletion of mouse cells, RNA was extracted from tumor cells or tissue by lysing in RLTplus RNA lysis buffer supplemented with 1% 2-mercaptoethanol (Qiagen), freezing the lysates at −80° C. and then thawing the lysates for RNA extraction using an RNeasy isolation kit (Qiagen). Alternatively, primary MEL tumor resection samples (e.g. MEL26) or primary tissue biopsy material from uveal melanoma (e.g. UVM1) that had been preserved in RNA Later® (Ambion) were processed and RNA was isolated per the manufacturor's instructions. Finally, RNA was quantified using a Nanodrop spectrophotometer (Thermo Scientific) and/or a Bioanalyzer 2100 (Agilent Technologies) and the resulting total RNA preparations were assessed by next-generation sequencing and gene expression analyses.

Whole transcriptome sequencing of high quality RNA was performed and results were analyzed using an Applied Biosystems (ABI) Sequencing by Oligo Ligation/Detection (SOLiD) 4.5 or SOLiD 5500×1 next generation sequencing system (Life Technologies). SOLiD whole transcriptome analysis was performed with cDNA generated from 1 ng RNA from bulk MEL tumor samples using either a modified whole transcriptome protocol from ABI designed for low input total RNA or the Ovation RNA-Seq System V2™ (NuGEN Technologies). The resulting cDNA library was fragmented, and barcode adapters were added to allow pooling of fragment libraries from different samples during sequencing runs. Data generated by the SOLiD platform mapped to 34,609 genes as annotated by RefSeq version 47 using NCBI version hg19.2 of the published human genome and provided verifiable measurements of RNA levels in most samples. Sequencing data from the SOLiD platform is nominally represented as a transcript expression value using the metrics RPM (reads per million) or RPKM (read per kilobase per million) mapped to exon regions of genes, enabling basic gene expression analysis to be normalized and enumerated as RPM_Transcript or RPKM_Transcript. As shown in FIG. 1, DLL3 mRNA expression was elevated in normal melanocytes and some of the MEL PDX tumor lines that were tested (e.g. MEL3, MEL13), while in other MEL and UVM PDX tumor lines there was lower DLL3 mRNA expression (e.g. MEL26, UVM1).

The identification of elevated DLL3 mRNA expression in a subset of MEL tumors was a preliminary indication that DLL3 may merit further evaluation as a potential diagnostic and/or immunotherapeutic target in melanoma.

Example 2

Detection of DLL3 mRNA in Tumors Using QRT-PCR

To confirm mRNA expression of DLL3 in MEL, qRT-PCR was performed on MEL PDX cell lines using the Fluidigm BioMark™ HD System according to industry standard protocols. RNA was extracted from bulk MEL PDX tumor cells as described in Example 1. 1 ng of RNA was converted to cDNA using the High Capacity cDNA Archive kit (Life Technologies) according to the manufacturer's instructions. cDNA material, pre-amplified using a DLL3-specific Taqman assay, was then used for subsequent qRT-PCR experiments.

Figure 2:
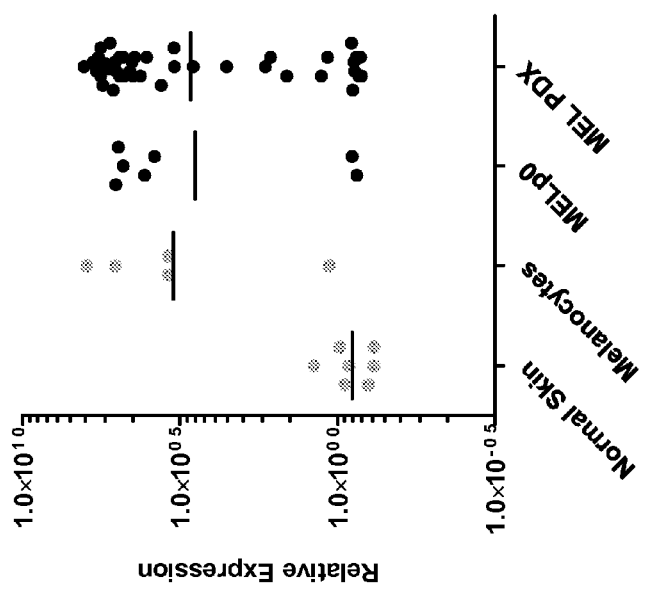
FIG. 2 depicts the relative expression levels of DLL3 transcripts as measured by qRT-PCR in a variety of RNA samples isolated from normal skin, keratinocytes and fibroblasts (Normal skin), cultured normal melanocytes, primary patient biopsy specimens (denoted with "p0"), and MEL patient-derived xenograft (PDX) tumors passaged through mice.

Expression in normal skin cells and melanocytes was compared to expression in primary MEL biopsies and MEL PDX lines (FIG. 2; each dot represents the relative expression of a unique individual normal tissue or PDX line after normalization to endogenous controls/normalizing genes; the horizontal lines represent the geometric mean of the samples in each set of similar samples). In all instances below, high expression of DLL3 is defined as those tumors having expression which is higher than the average of the geometric means for the melanocyte, MELp0 and MEL PDX samples, which is approximately 1×10⁵. No DLL3 mRNA was detected in three normal skin samples, two keratinocyte samples, and two normal human diploid fibroblast samples (collectively labeled Normal Skin, FIG. 2). In contrast, high DLL3 mRNA expression was seen in four of five normal melanocyte samples. Likewise, in about half of the MEL PDX, high DLL3 mRNA was detected, including 25/42 MEL PDX. This observation extends to primary biopsy samples of MEL (MELp0), which showed that DLL3 mRNA was detected in 5/7 primary MEL biopsy samples. This includes two primary biopsy (p0) samples used to establish PDX models from the same patient where we confirmed both the primary biopsy and the established PDX line have equal expression levels of DLL3 mRNA. A specific example is MEL19 in which both the p0 primary biopsy sample and the passaged PDX samples have high expression of DLL3 mRNA. This demonstrates that expression of DLL3 mRNA is not just a consequence of passaging MEL PDX in mice.

The above qRT-PCR results were similar to the results observed in Example 1, demonstrating mRNA expression of DLL3 in both normal melanocytes and about half of MEL PDX. However, qRT-PCR showed that other components of normal skin, including fibroblasts and keratinocytes, have no expression of DLL3 mRNA. The qRT-PCR results demonstrate that many MEL PDX express high DLL3, indicating that DLL3 may be a good target in the development of a therapeutic for melanoma.

Example 3

Determination of DLL3 mRNA Expression in Tumors Using Microarray

DLL3 mRNA expression was determined using microarray analyses to confirm the results from Examples 1 and 2 above. 1-2 µg of whole tumor total RNA was derived, substantially as described in Example 1, from MEL PDX cell lines and from normal cells including skin, peripheral blood mononuclear cells (PBMC), breast, colon, heart, kidney, liver, lung, ovary, pancreas, spleen and stomach. The samples were analyzed using the Agilent SurePrint GE Human 8×60 v2 microarray platform which contains 50,599 biological probes designed against 27,958 genes and 7,419 lncRNAs in the human genome. Standard industry practices were used to normalize and transform the intensity values to quantify gene expression for each sample. The normalized intensity of DLL3 expression in each sample is plotted in FIG. 3 and the geometric mean derived for each tumor type is indicated by the horizontal bar.

Figure 3:
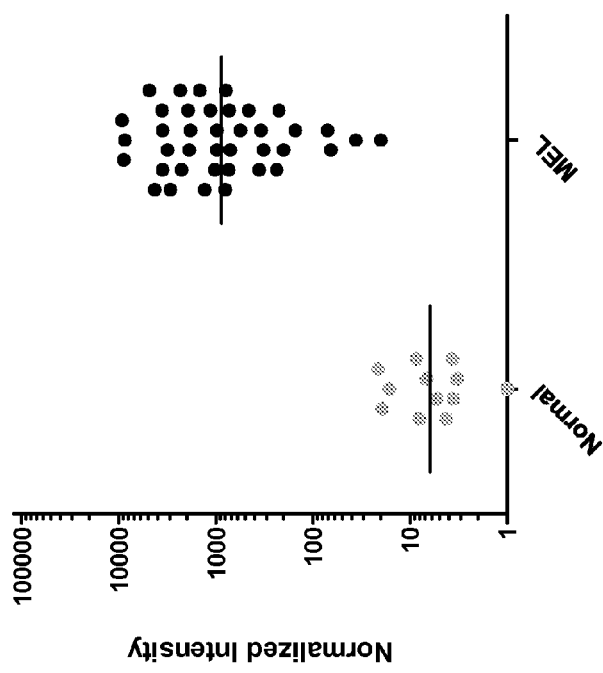
FIG. 3 shows the normalized intensity value of DLL3 transcript expression measured by microarray hybridization in normal tissues and MEL PDX cell lines.

FIG. 3 shows that mRNA expression of DLL3 is elevated in MEL PDX 100-fold over normal tissues, with only background expression detected in normal tissues. Specifically MEL19 has a normalized intensity value of 4800, while MEL6 has a normalized intensity value of 744, indicating lower levels of mRNA in MEL6 PDX. This confirms the mRNA expression results in Example 2, and extends the data to suggest there is a good therapeutic window of expression in MEL PDX above the normal tissues examined.

Example 4

DLL3 Expression in Tumors from the Cancer Genome Atlas

Overexpression of DLL3 mRNA in MEL tumors was confirmed using a large, publically available dataset of tumor and normal samples known as The Cancer Genome Atlas (TCGA). DLL3 expression data from the Illumina-HiSeq_RNASeqV2 platform was downloaded from the TCGA Data Portal (https://tcga-data.nci.nih.gov/tcga/tcga-Download.jsp) and parsed to aggregate the reads from the individual exons of each gene to generate a single value read per kilobase of exon per million mapped reads (RPKM). FIG. 4A shows DLL3 expression is substantially elevated in about half of primary MEL tumors relative to normal tissues found in the TCGA database. In contrast, very low RPKM levels in normal breast, kidney, colon, lung and prostate tissue demonstrate the lack of DLL3 expression. These data confirm the previous observations that elevated DLL3 mRNA can be found in many MEL tumors but not in normal tissues, implying there is a good therapeutic index above normal tissues and therefore anti-DLL3 antibodies and ADCs may be useful therapeutics for these tumors.

FIG. 4B shows Kaplan Meier survival curves for a subset of MEL TCGA tumors where patient survival data was available. Patients were stratified based on high expression of DLL3 mRNA i.e. expression over the threshold index value or low expression of DLL3 mRNA i.e. expression under the threshold index value in melanoma tumors. The threshold index value was calculated as the arithmetic mean of the RPKM values, which was calculated to be 11.1.

The "numbers at risk" listed below the plot shows the number of surviving patients remaining in the dataset every 2000 days after the day at which each patient was first diagnosed (day 0). The prognostic relevance of DLL3 expression for melanoma patient survival was estimated by fitting a Cox proportional hazards regression model to the TCGA survival and DLL3 RNA-Seq expression data for 270 patients. This was done using the 'coxph' function in the R 'survival' package. DLL3 expression was found to be a significant variable (p=0.00074 by the Wald test), with a hazard ratio of 1.009 (95% confidence interval 1.004-1.014). These data show that patients with MEL tumors exhibiting high expression of DLL3 have a much shorter survival time compared to patients with MEL tumors exhibiting low expression of DLL3. Thus, high expression of DLL3 in melanoma tumors correlates with poor survival, and highlights the usefulness of anti-DLL3 therapies to treat melanoma, and the usefulness of DLL3 expression as a prognostic biomarker on the basis of which treatment decisions can be made.

To determine whether DLL3 expression correlated with stage of disease progression at diagnosis, pathology reports associated with each TCGA sample were used. Where staging was not explicitly provided in supporting pathology comments, tumors were staged in accordance with AJCC 7$^{th}$ Edition guidance on Melanoma of the Skin Staging based on data present in the metadata supporting the TCGA dataset. The threshold index value for DLL3 expression was found to be 10.3, 13.4, 7.7 and 17 for Stages I, II, III and IV, respectively). The results of the analysis showed that in Stage II patients, DLL3 expression was found to be a significant variable (p=0.0029), with a hazard ratio of 1.001 (95% confidence interval 1.004-1.017), meaning that patients that have a faster progression and poor prognosis of disease have increased expression of DLL3. DLL3 expression was also found to be a significant variable for Stage III patients (FIG. 4C). This shows that DLL3 expression in early stage, non-metastatic melanoma, is a useful biomarker of poor prognosis, and argues for treating even early stage patients that express DLL3 with an anti-DLL3 therapy or other melanoma therapeutics.

Example 5

Generation of Anti-DLL3 Antibodies

Anti-DLL3 murine antibodies were produced as follows. In a first immunization campaign, three mice (one from each of the following strains: Balb/c, CD-1, FVB) were inoculated with human DLL3-Fc protein (hDLL3-Fc) emulsified with an equal volume of TiterMax® or alum adjuvant. The hDLL3-Fc fusion construct was purchased from Adipogen International (Catalog No. AG-40A-0113). An initial immunization was performed with an emulsion of 10 μg hDLL3-Fc per mouse in TiterMax. Mice were then boosted biweekly with 5 μg hDLL3-Fc per mouse in alum adjuvant. The final injection prior to fusion was with 5 μg hDLL3-Fc per mouse in PBS.

In a second immunization campaign six mice (two each of the following strains: Balb/c, CD-1, FVB), were inoculated with hDLL3-His protein (hDLL3-His), emulsified with an equal volume of TiterMax® or alum adjuvant. Recombinant hDLL3-His protein was purified from the supernatants of CHO-S cells engineered to overexpress hDLL3-His. The initial immunization was with an emulsion of 10 μg hDLL3-His per mouse in TiterMax. Mice were then boosted biweekly with 5 μg hDLL3-His per mouse in alum adjuvant. The final injection was with $2 \times 10^5$ HEK-293T cells engineered to overexpress hDLL3.

Solid-phase ELISA assays were used to screen mouse sera for mouse IgG antibodies specific for human DLL3. A positive signal above background was indicative of antibodies specific for DLL3. Briefly, 96 well plates were coated with recombinant hDLL3-His at 0.5 μg/ml in ELISA coating buffer overnight. After washing with PBS containing 0.02% (v/v) Tween 20, the wells were blocked with 3% (w/v) BSA in PBS, 200 μL/well for 1 hour at room temperature. Mouse serum was titrated (1:100, 1:200, 1:400, and 1:800) and added to the DLL3 coated plates at 50 μL/well and incubated at room temperature for 1 hour. The plates were washed and then incubated with 50 μL/well HRP-labeled goat anti-mouse IgG diluted 1:10,000 in 3% BSA-PBS or 2% FCS in PBS for 1 hour at room temperature. Again the plates were washed and 40 μL/well of a TMB substrate solution (Thermo Scientific) was added for 15 minutes at room temperature. After developing, an equal volume of 2N H$_2$SO$_4$ was added to stop substrate development and the plates were analyzed by spectrophotometer at OD 450.

Sera-positive immunized mice were sacrificed and draining lymph nodes (popliteal, inguinal, and medial iliac) were dissected and used as a source for antibody producing cells. Cell suspensions of B cells (approximately $229 \times 10^6$ cells from the hDLL3-Fc immunized mice, and $510 \times 10^6$ cells from the hDLL3-His immunized mice) were fused with non-secreting P3×63Ag8.653 myeloma cells at a ratio of 1:1 by electro cell fusion using a model BTX Hybrimmune System (BTX Harvard Apparatus). Cells were re-suspended in hybridoma selection medium consisting of DMEM medium supplemented with azaserine, 15% fetal clone I serum, 10% BM Condimed (Roche Applied Sciences), 1 mM nonessential amino acids, 1 mM HEPES, 100 IU penicillin-streptomycin, and 50 µM 2-mercaptoethanol, and were cultured in four T225 flasks in 100 mL selection medium per flask. The flasks were placed in a humidified 37° C. incubator containing 5% $CO_2$ and 95% air for six to seven days.

On day six or seven after the fusions the hybridoma library cells were collected from the flasks and plated at one cell per well (using the FACSAria I cell sorter) in 200 µL of supplemented hybridoma selection medium (as described above) into 64 Falcon 96-well plates for the hDLL3-Fc immunization campaign, and 48 96-well plates for the hDLL3-His immunization campaign. The rest of the library was stored in liquid nitrogen for future library testing and screening.

The hybridomas were cultured for ten days and the supernatants were screened for antibodies specific to hDLL3 using flow cytometry performed as follows. $1 \times 10^5$ per well of HEK-293T cells engineered to overexpress hDLL3 were incubated for 30 minutes with 25 µL hybridoma supernatant. Cells were washed with PBS/2% FCS and then incubated with 25 µL per sample DyeLight 649 labeled goat-anti-mouse IgG, Fc fragment specific secondary diluted 1:300 in PBS/2% FCS. After a 15 minute incubation cells were washed twice with PBS/2% FCS and re-suspended in PBS/2% FCS with DAPI and analyzed by flow cytometry for fluorescence exceeding that of cells stained with an isotype control antibody.

The hDLL3-His immunization campaign yielded approximately 50 murine anti-hDLL3 antibodies and the hDLL3-Fc immunization campaign yielded approximately 90 murine anti-hDLL3 antibodies.

Example 6

Binding Characteristics of Anti-DLL3 Antibodies

Various methods were used to analyze the binding characteristics of selected anti-DLL3 antibodies generated as set forth in Example 5 above. The antibodies were characterized as to affinity, kinetics, binning and binding location on the hDLL3 protein (FIG. 5.)

The affinity of select antibodies for hDLL3 protein was determined by surface plasmon resonance using a BIAcore 2000 (GE Healthcare). An anti-mouse antibody capture kit was used to immobilize mouse anti-DLL3 antibodies on a CMS biosensor chip. Prior to each antigen injection cycle, murine antibodies at a concentration of 2 µg/mL were captured on the surface with a contact time of 2 minutes and a flow rate of 5 µL/min. The captured antibody loading from baseline was constant at 80-120 response units. Following antibody capture and 1 minute baseline, monomeric hDLL3-His antigen was flowed over the surface at concentrations of 25 nM, 12.5 nM and 6.25 nM for a 4 minute association phase followed by a 4 minute dissociation phase at a flow rate of 5 µL/min. The anti-mouse antibody capture kit was regenerated with 2 minute contact time of 10 mM Glycine, pH 1.7 at 10 µL/minute following each cycle. The data was processed by subtracting a control Mouse IgG surface response from the specific antibody surface response and data was truncated to the association and dissociation phase. The resulting response curves were used to fit a 1:1 Langmuir binding model and to generate an apparent affinity using the calculated $k_{on}$ and $k_{off}$ kinetics constants using BiaEvaluation Software 3.1 (GE Healthcare). The selected antibodies exhibited affinities for hDLL3 in the nanomolar range (FIG. 5).

The affinity of the antibodies for hDLL3 protein was also determined from kinetics curves generated with a ForteBio RED as follows. Anti-DLL3 antibodies were immobilized onto anti-mouse Fc capture biosensors with a contact time of 3 minutes and a flow rate of 1000 rpm. The captured antibody loading from baseline was constant at 0.3-1 units. Following antibody capture and 30 second baseline, the biosensors were dipped into a 200 nM solution of hDLL3-His for a 4 minute association phase followed by a 3 minute dissociation phase at a shaking rate of 1000 rpm. The biosensors were regenerated by dipping into 10 mM glycine, pH 1.7 following each cycle. The data was processed by subtracting a control mouse IgG surface response from the specific antibody response and data was truncated to the association and dissociation phase. The association and dissociation curves were used to estimate the affinities of selected antibodies.

Antibody binning was determined using a ForteBio RED to identify competing antibodies that bound to the same or different bins. A reference antibody (Ab1) was captured onto an anti-mouse capture chip, a high concentration of non-binding antibody was then used to block the chip and a baseline was collected. Monomeric, recombinant human DLL3-Flag (Adipogen International) was then captured by the specific antibody (Ab1) and the tip was dipped into a well with either the same antibody (Ab1) as a control or into a well with a different test antibody (Ab2). If additional binding was observed with a new antibody, then Ab1 and Ab2 were determined to be in a different bin. If no further binding occurred, as determined by comparing binding levels with the control Ab1, then Ab2 was determined to be in the same bin. As known in the art this process can be expanded to screen large libraries of unique antibodies using a full row of antibodies representing unique bins in a 96-well plate. The anti-DLL3 antibodies that were tested, bound to at least nine different bins (designated as Bins A though I in FIG. 5). Based on the apparent size of the DLL3 antigen (where the ECD is approximately 56 kD) and the resolution of the binning methodology employed, it is believed that the nine identified bins represent the majority of the bins present on the DLL3 extracellular antigen.

Example 7

Sequencing of Anti-DLL3 Antibodies

Antibodies generated as described above in Example 5 were selected for sequencing based on their affinity for DLL3. Hybridoma cells expressing the desired antibodies were lysed in Trizol® reagent (Trizol® Plus RNA Purification System, Life Technologies) to prepare the RNA encoding the antibodies. Between $10^4$ and $10^5$ cells were re-suspended in 1 mL Trizol and shaken vigorously after addition of 200 µL chloroform. Samples were then centrifuged at 4° C. for 10 minutes and the aqueous phase was transferred to a fresh microfuge tube and an equal volume of 70% ethanol was added. The sample was loaded on an RNeasy Mini spin column, placed in a 2 mL collection tube and processed according to the manufacturer's instructions. Total RNA was extracted by elution by adding 100 µL RNase-free water directly to the spin column membrane.

The quality of the RNA preparations was determined by fractionating 3 µL in a 1% agarose gel before being stored at −80° C. until used.

The variable region of the Ig heavy chain of each hybridoma was amplified using a 5' primer mix comprising 32 mouse specific leader sequence primers designed to target the complete mouse VH repertoire in combination with a 3' mouse Cγ primer specific for all mouse Ig isotypes. Similarly, a primer mix containing thirty two 5' Vκ leader sequences designed to amplify each of the Vκ mouse families was used in combination with a single reverse primer specific to the mouse kappa constant region in order to amplify and sequence the kappa light chain. For antibodies containing a lambda light chain, amplification was performed using three 5' V$_λ$ leader sequences in combination with one reverse primer specific to the mouse lambda constant region. The VH and VL transcripts were amplified from 100 ng total RNA using the Qiagen One Step RT-PCR kit as follows. A total of eight RT-PCR reactions were run for each hybridoma, four for the Vκ light chain and four for the Vγ heavy chain. PCR reaction mixtures included 3 µL of RNA, 0.5 µL of 100 µM of either heavy chain or kappa light chain primers (custom synthesized by Integrated Data Technologies), 5 µL of 5×RT-PCR buffer, 1 µL dNTPs, 1~L of enzyme mix containing reverse transcriptase and DNA polymerase, and 0.4 µL of ribonuclease inhibitor RNasin (1 unit). The thermal cycler program was RT step 50° C. for 30 minutes, 95° C. for 15 minutes followed by 30 cycles of (95° C. for 30 seconds, 48° C. for 30 seconds, 72° C. for 1 minute). There was then a final incubation at 72° C. for 10 minutes.

The extracted PCR products were sequenced using the same specific variable region primers as described above for the amplification of the variable regions. To prepare the PCR products for direct DNA sequencing, they were purified using the QIAquick™ PCR Purification Kit (Qiagen) according to the manufacturer's protocol. The DNA was eluted from the spin column using 50 µL of sterile water and then sequenced directly from both strands. Nucleotide sequences were analyzed using the IMGT sequence analysis tool (http://www.imgt.org/IMGTmedical/sequence_analysis.html) to identify germline V, D and J gene members with the highest sequence homology. The derived sequences were compared to known germline DNA sequences of the Ig V- and J-regions by alignment of VH and VL genes to the mouse germline database using a proprietary antibody sequence database.

FIG. 6A depicts the contiguous amino acid sequences of numerous novel murine light chain variable regions from anti-DLL3 antibodies and exemplary humanized light chain variable regions derived from the variable light chains of representative murine anti-DLL3 antibodies. FIG. 6B depicts the contiguous amino acid sequences of novel murine heavy chain variable regions from the same anti-DLL3 antibodies and humanized heavy chain variable regions derived from the same murine antibodies providing the humanized light chains. Murine light and heavy chain variable region amino acid sequences are provided in SEQ ID NOS: 21-387, odd numbers while humanized light and heavy chain variable region amino acid sequences are provided in SEQ ID NOS: 389-407, odd numbers.

Thus, taken together FIGS. 6A and 6B provide the annotated sequences of several murine anti-DLL3 antibodies, termed SC16.3, SC16.4, SC16.5, SC16.7, SC16.8, SC16.10, SC16.11, SC16.13, SC16.15, SC16.18, SC16.19, SC16.20, SC16.21, SC16.22, SC16.23, SC16.25, SC16.26, SC16.29, SC16.30, SC16.31, SC16.34, SC16.35, SC16.36, SC16.38, SC16.41, SC16.42, SC16.45, SC16.47, SC16.49, SC16.50, SC16.52, SC16.55, SC16.56, SC16.57, SC16.58, SC16.61, SC16.62, SC16.63, SC16.65, SC16.67, SC16.68, SC16.72, SC16.73, SC16.78, SC16.79, SC16.80, SC16.81, SC16.84, SC16.88, SC16.101, SC16.103, SC16.104, SC16.105, SC16.106, SC16.107, SC16.108, SC16.109, SC16.110, SC16.111, SC16.113, SC16.114, SC16.115, SC16.116, SC16.117, SC16.118, SC16.120, SC16.121, SC16.122, SC16.123, SC16.124, SC16.125, SC16.126, SC16.129, SC16.130, SC16.131, SC16.132, SC16.133, SC16.134, SC16.135, SC16.136, SC16.137, SC16.138, SC16.139, SC16.140, SC16.141, SC16.142, SC16.143, SC16.144, SC16.147, SC16.148, SC16.149 and SC16.150 and humanized antibodies, termed hSC16.13, hSC16.15, hSC16.25, hSC16.34 and hSC16.56.

For the purposes of the instant application the SEQ ID NOS of each particular antibody are sequential odd numbers. Thus the monoclonal anti-DLL3 antibody, SC16.3, comprises amino acid SEQ ID NOS: 21 and 23 for the light and heavy chain variable regions respectively; SC16.4 comprises SEQ ID NOS: 25 and 27; SC16.5 comprises SEQ ID NOS: 29 and 31, and so on. The corresponding nucleic acid sequence for each antibody amino acid sequence is included in the appended sequence listing and has the SEQ ID NO immediately preceding the corresponding amino acid SEQ ID NO. Thus, for example, the SEQ ID NOS of the VL and VH of the SC16.3 antibody are 21 and 23, respectively, and the SEQ ID NOS of the nucleic acid sequences of the VL and VH of the SC16.3 antibody are SEQ ID NOS: 20 and 22, respectively.

It should be noted that, due to sequencing anomalies, certain heavy and light chain variable region sequences were prematurely truncated during the sequencing process. This resulted in the omission of one or more amino acids in the reported FR4 sequence. In such cases compatible amino acids (determined by review of corresponding sequences from other antibody clones) have been supplied to essentially complete the variable region sequence. For example, the residues "IK" were added to the terminal end of the SC16.22 light chain sequence in FIG. 6A (SEQ ID NO: 73) to provide an operable light chain variable region with a complete framework 4. Bases encoding the added amino acids were similarly added to the corresponding nucleic acid sequence (SEQ ID NO: 72) to ensure consistency. In each such case in FIGS. 6A and 6B (but not in the appended sequence listing) the added amino acids are underlined and bolded so as to be readily identified. The CDRs are defined as per Kabat et al. (supra) using a proprietary version of the Abysis database.

Example 8

Generation of Chimeric and Humanized Anti-DLL3 Antibodies

Five murine antibodies from Example 2 (SC16.13, SC16.15, SC16.25, SC16.34 and SC16.56) were used to derive chimeric antibodies comprising human constant regions with murine variable regions and humanized antibodies comprising murine CDRs grafted into a human acceptor antibody. In some embodiments these derived antibodies (chimeric or humanized) may be incorporated in the disclosed anti-DLL3 ADCs.

Chimeric anti-DLL3 antibodies were generated using art-recognized techniques as follows. Total RNA was extracted from the hybridomas and amplified as set forth in Example 1. Data regarding V, D and J gene segments of the VH and VL chains of the murine antibodies were obtained from the derived nucleic acid sequences. Primer sets specific to the leader sequence of the VH and VL chain of the antibody were designed using the following restriction sites: AgeI and XhoI for the VH fragments, and XmaI and DraIII for the VL fragments. PCR products were purified with a QIAquick PCR purification kit (Qiagen), followed by digestion with restriction enzymes AgeI and XhoI for the VH fragments and XmaI and DraIII for the VL fragments. The VL and VH digested PCR products were purified and ligated into kappa $C_L$ (SEQ ID NO: 5) human light chain constant region expression vector or IgG1 (SEQ ID NO: 6) human heavy chain constant region expression vector, respectively.

Ligation reactions were performed in a total volume of 10 μL, with 200 U T4-DNA Ligase (New England Biolabs), 7.5 μL of digested and purified gene-specific PCR product and 25 ng linearized vector DNA. Competent E. coli DH10B bacteria (Life Technologies) were transformed via heat shock at 42° C. with 3 μL ligation product and plated onto plates with ampicillin at a concentration of 100 μg/mL.

Following purification and digestion of the amplified ligation products, the VH fragment was cloned into the AgeI-XhoI restriction sites of the pEE6.4HuIgG1 expression vector (Lonza) and the VL fragment was cloned into the XmaI-DraIII restriction sites of the pEE12.4Hu-Kappa expression vector (Lonza).

Chimeric antibodies were expressed by co-transfection of HEK-293T cells with pEE6.4HuIgG1 and pEE12.4Hu-Kappa expression vectors. Prior to transfection the HEK-293T cells were cultured in 150 mm plates under standard conditions in Dulbecco's Modified Eagle's Medium (DMEM) supplemented with 10% heat inactivated FCS, 100 μg/mL streptomycin and 100 U/mL penicillin G. For transient transfections cells were grown to 80% confluency. 12.5 μg each of pEE6.4HuIgG1 and pEE12.4Hu-Kappa vector DNA were added to 50 μL, HEK-293T transfection reagent in 1.5 mL Opti-MEM. The mix was incubated for 30 minutes at room temperature and plated. Supernatants were harvested three to six days after transfection. Culture supernatants containing recombinant chimeric antibodies were cleared from cell debris by centrifugation at 800×g for 10 minutes and stored at 4° C. Recombinant chimeric antibodies were purified by Protein A affinity chromatography.

The same murine anti-DLL3 antibodies (e.g. SC16.13, SC16.15, SC16.25, SC16.34 and SC16.56) were also used to derive CDR-grafted or humanized antibodies. The murine antibodies were humanized using a proprietary computer-aided CDR-grafting method (Abysis Database, UCL Business) and standard molecular engineering techniques as follows. Human framework regions of the variable regions were designed based on the highest homology between the framework sequences and CDR canonical structures of human germline antibody sequences, and the framework sequences and CDRs of the relevant mouse antibodies. For the purpose of the analysis the assignment of amino acids to each of the CDR domains was done in accordance with Kabat et al. numbering. Once the variable regions were selected, they were generated from synthetic gene segments (Integrated DNA Technologies). Humanized antibodies were cloned and expressed using the molecular methods described above for chimeric antibodies.

The genetic composition for the selected human acceptor variable regions are shown in TABLE 4 immediately below for each of the humanized antibodies. The sequences depicted in TABLE 4 correspond to the contiguous variable region sequences set forth in SEQ ID NOS: 389 and 391 (hSC16.13), SEQ ID NOS: 393 and 395 (hSC16.15), SEQ ID NOS: 397 and 399 (hSC16.25), SEQ ID NOS: 401 and 403 (hSC16.34) and SEQ ID NOS: 405 and 407 (hSC16.56). TABLE 4 shows that no framework changes or back mutations were necessary to maintain the favorable binding properties of the selected antibodies.

TABLE 4

| mAb | human VH | human DH | human JH | FW changes | human VK | human JK | FW changes |
|---|---|---|---|---|---|---|---|
| hSC16.13 | IGHV2-5*01 | IGHD1-1 | JH6 | None | IGKV1-39*01 | JK1 | None |
| hSC16.15 | IGHV1-46*01 | IGHD2-2 | JH4 | None | IGKV1-13*02 | JK4 | None |
| hSC16.25 | IGHV2-5*01 | IGHD3-16 | JH6 | None | IGKV6-21*01 | JK2 | None |
| hSC16.34 | IGHV1-3*02 | IGHD3-22 | JH4 | None | IGKV1-27*01 | JK1 | None |
| hSC16.56 | IGHV1-18*01 | IGHD2-21 | JH4 | None | IGKV3-15*01 | JK2 | None |

Although no residues were altered in the framework regions, in one of the humanized clones (hSC16.13) mutations were introduced into heavy chain CDR2 to address stability concerns. The binding affinity of the antibody with the modified CDR was checked to ensure that it was equivalent to either the corresponding chimeric or murine antibody.

Following humanization of the selected antibodies the resulting VL and VH chain amino acid sequences were analyzed to determine their homology with regard to the murine donor and human acceptor light and heavy chain variable regions. The results shown in TABLE 5, immediately below, reveal that the humanized constructs consistently exhibited a higher homology with respect to the human acceptor sequences than with the murine donor sequences. The murine heavy and light chain variable regions show a similar overall percentage homology to a closest match of human germline genes (85%-93%) compared with the homology of the humanized antibodies and the donor hybridoma protein sequences (74%-83%).

TABLE 5

| mAb | Homology to Human (CDR acceptor) | Homology to Murine Parent (CDR donor) |
|---|---|---|
| hSC16.13 HC | 93% | 81% |
| hSC16.13 LC | 87% | 77% |
| hSC16.15 HC | 85% | 83% |
| hSC16.15 LC | 85% | 83% |
| hSC16.25 HC | 91% | 83% |
| hSC16.25 LC | 85% | 79% |

TABLE 5-continued

| mAb | Homology to Human (CDR acceptor) | Homology to Murine Parent (CDR donor) |
|---|---|---|
| hSC16.34 HC | 87% | 79% |
| hSC16.34 LC | 85% | 81% |
| hSC16.56 HC | 87% | 74% |
| hSC16.56 LC | 87% | 76% |

Each of the derived humanized constructs were analyzed using surface plasmon resonance, as described in Example 6, to determine if the CDR grafting process had appreciably altered their apparent affinity for DLL3 protein. The humanized constructs were compared with chimeric antibodies comprising the murine parent (or donor) heavy and light chain variable domains and a human constant region substantially equivalent to that used in the humanized constructs. The humanized anti-DLL3 antibodies exhibited binding characteristics roughly comparable to those shown by the chimeric parent antibodies (data not shown).

Example 9

Domain and Epitope Mapping of Anti-DLL3 Antibodies

In order to characterize and position the epitopes that the disclosed anti-DLL3 antibodies bind to, domain-level epitope mapping was performed using a modification of the protocol described by Cochran et al., 2004 (supra). Individual domains of DLL3 comprising specific amino acid sequences were expressed on the surface of yeast, and binding by each anti-DLL3 antibody was determined through flow cytometry.

Yeast display plasmid constructs were created for the expression of the following constructs: DLL3 extracellular domain (amino acids 27-466); DLL1-DLL3 chimera, which consists of the N-terminal region and DSL domain of DLL1 (amino acids 22-225) fused to EGF-like domains 1 through 6 of DLL3 (amino acids 220-466); DLL3-DLL1 chimera, which consists of the N-terminal region and DSL domain of DLL3 (amino acids 27-214) fused to EGF-like domains 1 through 8 of DLL1 (amino acids 222-518); EGF1 (amino acids 215-249); EGF2 (amino acids 274-310); EGF1 and EGF2 (amino acids 215-310); EGF3 (amino acids 312-351); EGF4 (amino acids 353-389); EGF5 (amino acids 391-427); and EGF6 (amino acids 429-465). (For domain information see generally UniProtKB/Swiss-Prot database entry Q9NYJ7. Note that the amino acid numbering references an unprocessed DLL3 protein with a leader sequence included in the sequence set forth in SEQ ID NO. 1.) For analysis of the N-terminal region or the EGF domains as a whole, chimeras with the family member DLL1 (DLL1-DLL3 and DLL3-DLL1) were used as opposed to fragments to minimize potential problems with protein folding. Domain-mapped antibodies had previously been shown not to cross-react with DLL1 indicating that any binding to these constructs was occurring through association with the DLL3 portion of the construct. These plasmids were transformed into yeast, which were then grown and induced as described in Cochran et al.

To test for binding to a particular construct, 200,000 induced yeast cells expressing the desired construct were washed twice in PBS+1 mg/mL BSA (PBSA), and incubated in 50 μL of PBSA with biotinylated anti-HA clone 3F10 (Roche Diagnostics) at 0.1 μg/mL and either 50 nM purified antibody or 1:2 dilution of unpurified supernatant from hybridomas cultured for 7 days. Cells were incubated for 90 minutes on ice, followed by two washes in PBSA. Cells were then incubated in 50 μL PBSA with the appropriate secondary antibodies: for murine antibodies, Alexa 488 conjugated streptavidin, and Alexa 647 conjugated goat anti mouse (Life Technologies) were added at 1 μg/mL each; and for humanized or chimeric antibodies, Alexa 647 conjugated streptavidin (Life Technologies) and R-phycoerythrin conjugated goat anti human (Jackson Immunoresearch) were added at 1 μg/mL each. After a twenty minute incubation on ice, cells were washed twice with PBSA and analyzed on a FACS Canto II. Antibodies that bound to DLL3-DLL1 chimera were designated as binding to the N-terminal region+DSL. Antibodies that bound specifically to an epitope present on a particular EGF-like domain were designated as binding to its respective domain (FIG. 7.)

In order to classify an epitope as conformational (e.g., discontinuous) or linear, yeast displaying the DLL3 ECD was heat treated for 30 minutes at 80° C. to denature the DLL3 ECD, and then washed twice in ice-cold PBSA. The ability of anti-DLL3 antibodies to bind the denatured yeast was tested by flow cytometry using the same staining protocol as described above. Antibodies that bound to both the denatured and native yeast were classified as binding to a linear epitope, whereas antibodies that bound native yeast but not denatured yeast were classified as conformationally specific.

Figure 7:
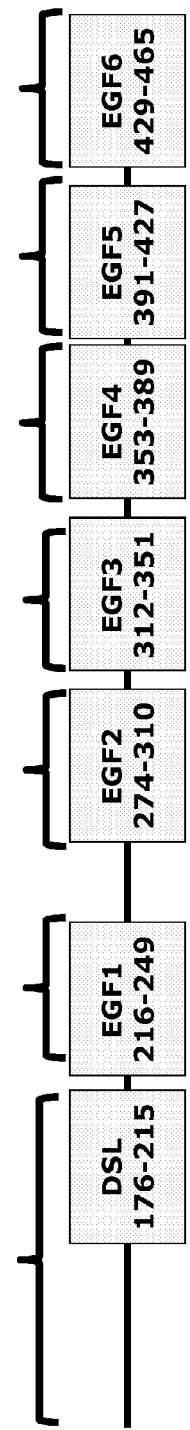
FIG. 7 depicts the results of domain level mapping analysis of exemplary anti-DLL3 antibodies.

A schematic summary of the domain-level epitope mapping data of the antibodies tested is presented in FIG. 7, with antibodies binding a linear epitope underlined and, where determined, the corresponding bin noted in parenthesis. A review of FIG. 7 shows that the majority of anti-DLL3 antibodies tended to map to epitopes found either in the N-terminal/DSL region of DLL3 or EGF2. FIG. 5 presents similar data in a tabular form on bin determination and domain mapping for various anti-DLL3 antibodies.

Fine epitope mapping was further performed on selected antibodies using one of two methods. The first method employed the Ph.D.-12 phage display peptide library kit (New England Biolabs) which was used in accordance with the manufacturer's instructions. The antibody for epitope mapping was coated overnight at 50 μg/mL in 3 mL 0.1 M sodium bicarbonate solution, pH 8, onto a Nunc MaxiSorp tube (Nunc). The tube was blocked with 3% BSA solution in bicarbonate solution. Then, $10^{11}$ input phage in PBS+0.1% Tween-20 was allowed to bind, followed by ten consecutive washes with 0.1% Tween-20 to wash away non-binding phage. Remaining phage were eluted with 1 mL 0.2 M glycine for 10 minutes at room temperature with gentle agitation, followed by neutralization with 150 μL 1M Tris-HCl pH 9. Eluted phage were amplified and panned again with $10^{11}$ input phage, using 0.5% Tween-20 during the wash steps to increase selection stringency. DNA from 24 plaques of the eluted phage from the second round was isolated using the Qiaprep M13 Spin kit (Qiagen) and sequenced. Binding of clonal phage was confirmed using an ELISA assay, where the mapped antibody or a control antibody was coated onto an ELISA plate, blocked, and exposed to each phage clone. Phage binding was detected using horseradish peroxidase conjugated anti-M13 antibody (GE Healthcare), and the 1-Step Turbo TMB ELISA solution (Pierce). Phage peptide sequences from specifically binding phage were aligned using Vector NTI (Life Technologies) against the antigen ECD peptide sequence to determine the epitope of binding.

Alternatively, a yeast display method (Chao et al., 2007, PMID: 17406305) was used to map the epitopes of selected antibodies. Libraries of DLL3 ECD mutants were generated with error prone PCR using nucleotide analogues 8-oxo-2'deoxyguanosine-5'-triphosphate and 2'-deoxy-p-nucleoside-5'triphosphate (TriLink Bio) for a target mutagenesis rate of one amino acid mutation per clone. These were transformed into a yeast display format. Using the technique described above for domain-level mapping, the library was stained for HA and antibody binding at 50 nM. Using a FACS Aria (BD), clones that exhibited a loss of binding compared to wild type DLL3 ECD were sorted. These clones were re-grown, and subjected to another round of FACS sorting for loss of binding to the target antibody. Using the Zymoprep Yeast Plasmid Miniprep kit (Zymo Research), individual ECD clones were isolated and sequenced. Where necessary, mutations were reformatted as single-mutant ECD clones using the Quikchange site directed mutagenesis kit (Agilent).

Individual ECD clones were next screened to determine whether loss of binding was due to a mutation in the epitope, or a mutation that caused misfolding. Mutations that involved cysteine, proline, and stop codons were automatically discarded due to the high likelihood of a misfolding mutation. Remaining ECD clones were then screened for binding to a non-competing, conformationally specific antibody. ECD clones that lost binding to non-competing, conformationally specific antibodies were concluded to contain misfolding mutations, whereas ECD clones that retained equivalent binding to wild type DLL3 ECD were concluded to be properly folded. Mutations in the ECD clones in the latter group were concluded to be in the epitope.

A summary of selected antibodies with their derived epitopes comprising amino acid residues that are involved in antibody binding are listed in TABLE 6 below. Antibodies SC16.34 and SC16.56 interact with common amino acid residues which is consistent with the binning information and domain mapping results shown in FIG. 5. Moreover, SC16.23 was found to interact with a distinct contiguous epitope and was found not to bin with SC16.34 or SC16.56. Note that for the purposes of the appended sequence listing SEQ ID NO: 4 comprises a placeholder amino acid at position 204.

TABLE 6

| Antibody Clone | Epitope | SEQ ID NO: |
|---|---|---|
| SC16.23 | Q93, P94, G95, A96, P97 | 3 |
| SC16.34 | G203, R205, P206 | 4 |
| SC16.56 | G203, R205, P206 | 4 |

Example 10

Preparation of Anti-DLL3 Antibody-Drug Conjugates

Anti-DLL3 antibody drug conjugates were prepared having the Ab-[L-D] structure as described above. Each ADC comprised an anti-DLL3 antibody covalently linked to a cytotoxin. ADCs were named, for example, SC16-LPBD1 or hSC16-LPBD1, where SC16 or hSC16 represents an exemplary humanized anti-DLL3 antibody, "L" represents a specific linker, preferably comprising a terminal maleimido moiety with a free sulfhydryl group, and "PBD1" represents the PBD having the structure shown above in Section IX of the current application.

LPBD1 drug-linker combinations were synthesized and purified using art recognized techniques as follows. The cysteine bonds of the selected anti-DLL3 antibody were reduced with a pre-determined molar addition of mol tris (2-carboxyethyl)-phosphine (TCEP) per mol antibody for 90 min. at 20° C. in phosphate buffered saline (PBS) with 5 mM EDTA. The linker-drug, dissolved in dimethyl acetamide (DMA), was added at a ratio of 3 mol/mol anti-DLL3 antibody. The reaction was allowed to proceed for 30 min. The unreacted drug-linker was capped by addition of an equivalent molar excess of N-Acetyl Cysteine. After a minimum quench time of 20 mins., the pH was adjusted to 6.0 with the addition of 0.5 M acetic acid and buffer exchanged by diafiltration using a 30 kDa membrane. The dialfiltered anti-DLL3 ADC was then formulated with sucrose and polysorbate-20 to the target final concentration. The resulting anti-DLL3 ADCs were analyzed for protein concentration (by measuring UV), aggregation (SEC), drug to antibody ratio (DAR) by reverse-phase HPLC (RP-HPLC) and in vitro cytotoxicity.

Example 11

Generation of Site-Specific Anti-DLL3 Antibodies

Four engineered human IgG1/kappa anti-DLL3 site-specific antibodies were constructed. Two of the four engineered antibodies comprised a native light chain constant region and had a mutation in the heavy chain, wherein cysteine 220 (C220) in the upper hinge region of the heavy chain, which forms an interchain disulfide bond with cysteine 214 in the light chain, was either substituted with serine (C220S) or removed (C220Δ). The remaining two engineered antibodies comprised a native heavy chain constant region and a mutated light chain, wherein cysteine 214 of the light chain was either substituted with serine (C214S) or removed (C214Δ). When assembled, the heavy and light chains formed antibodies comprising two free cysteines that are suitable for conjugation to a therapeutic agent. TABLE 7 immediately below summarizes the alterations. Unless otherwise noted, all numbering of constant region residues is in accordance with the EU numbering scheme as set forth in Kabat et al.

TABLE 7

| Designation | Antibody Component | Alteration | Const. Reg. SEQ ID NO: | SC16.56 SEQ ID NO: |
|---|---|---|---|---|
| ss1 | Heavy Chain | C220S | 7 | 16 |
|  | Light Chain | WT | 5 | 14 |
| ss2 | Heavy Chain | C220Δ | 8 | 17 |
|  | Light Chain | WT | 5 | 14 |
| ss3 | Heavy Chain | WT | 6 | 15 |
|  | Light Chain | C214Δ | 9 | 18 |
| ss4 | Heavy Chain | WT | 6 | 15 |
|  | Light Chain | C214S | 10 | 19 |

The engineered antibodies were generated as follows.

An expression vector encoding the humanized anti-DLL3 antibody hSC16.56 light chain (SEQ ID NO: 14) or heavy chain (SEQ ID NO: 15) derived as set forth in Example 8 were used as a template for PCR amplification and site directed mutagenesis. Site directed mutagenesis was performed using the Quick-Change® system (Agilent Technologies) according to the manufacturer's instructions.

For the two heavy chain mutants, the vector encoding the mutant C220S or C220Δ heavy chain of hSC16.56 was co-transfected with the native IgG1 kappa light chain of hSC16.56 in CHO-S cells and expressed using a mammalian transient expression system. The engineered anti-DLL3 site-specific antibodies containing the C220S or C220Δmutants were termed hSC16.56ss1 (SEQ ID NOS: 16 and 14) or hSC16.56ss2 (SEQ ID NOS: 17 and 14) respectively.

For the two light chain mutants, the vector encoding the mutant C214S or C214Δlight chain of hSC16.56 was co-transfected with the native IgG1 heavy chain of hSC16.56 in CHO-S cells and expressed using a mammalian transient expression system. The engineered antibodies were purified using protein A chromatography (MabSelect SuRe) and stored in appropriate buffer. The engineered anti-DLL3 site-specific antibodies containing the C214S or C214Δmutants were termed hSC16.56ss3 (SEQ ID NOS: 15 and 18) or hSC16.56ss4 (SEQ ID NOS: 15 and 19) respectively.

The engineered anti-DLL3 antibodies were characterized by SDS-PAGE to confirm that the correct mutants had been generated. SDS-PAGE was conducted on a pre-cast 10% Tris-Glycine mini gel from life technologies in the presence and absence of a reducing agent such as DTT (dithiothreitol). Following electrophoresis, the gels were stained with a colloidal coomassie solution. Band patterns of the two heavy chain (HC) mutants, hSC16.56ss1 (C220S) and hSC16.56ss2 (C220Δ) and the two light chain (LC) mutants, hSC16.56ss3 (C214S) and hSC16.56ss4 (C214Δ) were observed. Under reducing conditions, for each antibody, two bands corresponding to the free LCs and free HCs, were observed. This pattern is typical of IgG molecules in reducing conditions. Under non-reducing conditions, the four engineered antibodies (hSC16.56ss1-hSC16.56ss4) exhibited band patterns that were different from native IgG molecules, indicative of the absence of a disulfide bond between the HC and LC. All four mutants exhibited a band around 98 kD corresponding to the HC-HC dimer. The mutants with a deletion or mutation on the LC (hSC16.56ss3 and hSC16.56ss4) exhibited a single band around 24 kD corresponding to a free LC. The engineered antibodies containing a deletion or mutation on the heavy chain (hSC16.56ss1 and hSC16.56ss2) had a faint band corresponding to the free LC and a predominant band around 48 kD that corresponded to a LC-LC dimer. The formation of some amount of LC-LC species is expected with the ss1 and ss2 constructs due to the free cysteines on the c-terminus of each light chain.

Example 12

Conjugation of Site Specific Anti-DLL3 Antibodies Using a Selective Reduction Process Anti-DLL3 antibody drug conjugates (ADCs) were prepared having the Ab-[L-D] structure as described above, wherein the Ab moiety was a site specific antibody, for example, hSC16.56ss1, generated as set forth in Example 11 above. The desired product is an ADC that is maximally conjugated on the unpaired cysteine on each LC constant region and that minimizes ADCs having a drug to antibody ratio (DAR) which is greater than 2 (DAR>2) or less than 2 (DAR<2) while maximizing ADCs having a DAR of 2 (DAR=2).

In order to further improve the specificity of the conjugation and homogeneity of the final site-specific ADC, the site specific antibody (e.g. "hSC16.56ss1") was selectively reduced using, for example, a process comprising a stabilizing agent (e.g. L-arginine) and a mild reducing agent (e.g. glutathione) prior to conjugation with the linker-drug, followed by preparative hydrophobic interaction chromatography (HIC) that was used to separate the different DAR species. The above procedures were conducted, for example as described below.

A preparation of the site specific antibody was partially reduced in a buffer containing 1M L-arginine/5 mM glutathione, reduced (GSH)/5 mM EDTA, pH 8.0 for a minimum of one hour at room temperature. All preparations were then buffer exchanged into a 20 mM Tris/3.2 mM EDTA, pH 8.2 buffer using a 30 kDa membrane (Millipore Amicon Ultra) to remove the reducing buffer. The resulting partially reduced preparations were then conjugated to a cytotoxin (e.g. PBD1.) via a linker (e.g. maleimide linker) for a minimum of 30 mins. at room temperature. The reaction was then quenched with the addition of excess NAC to linker-drug using a 10 mM stock solution of NAC prepared in water. After a minimum quench time of 20 mins., the pH was adjusted to 6.0 with the addition of 0.5 M acetic acid. The site specific ADC was buffer exchanged into diafiltration buffer using a 30 kDa membrane. The site specific ADC preparation was then diluted with a high salt buffer to increase the conductivity to promote binding onto the resin, and then loaded on a Butyl HP resin chromatography column (GE Life Sciences). A decreasing salt gradient was then employed to separate the different DAR species based on hydrophobicity, where DAR=0 species elute first, followed by DAR=1, DAR=2, and then higher DAR species.

The final ADC "HIC purified DAR=2" preparation was analyzed using RP-HPLC to determine the percent conjugation on the HCs and LCs and the DAR distribution. The samples were also analyzed using analytical HIC to determine the amount of DAR=2 species relative to the unwanted DAR>2 and DAR<2 species.

Example 13

DLL3 Protein Expression in Tumors Using an ELISA Assay

Examples 1-4 demonstrated that DLL3 mRNA transcript levels are elevated in about 50% of MEL tumors compared to normal cells. In order to detect and quantify DLL3 protein expression, an electrochemiluminescent DLL3 sandwich ELISA assay was developed using the MSD Discovery Platform (Meso Scale Discovery) (the "MSD assay".)

The MSD assay was conducted as follows. PDX MEL tumors were excised from mice and flash frozen on dry ice/ethanol. Normal tissues were purchased from a commercial source. Protein Extraction Buffer (Biochain Institute) was added to the thawed tumor or normal tissue and pulverized using a TissueLyser system (Qiagen). Lysates were cleared by centrifugation (20,000 g, 20 minutes, 4° C.) and the total protein concentration in each lysate was quantified using bicinchoninic acid. The protein lysates were then normalized to 5 mg/mL and stored at −80° C. until assayed. DLL3 protein concentrations from the lysate samples were determined by interpolating the values from a standard protein concentration curve that was generated using purified recombinant DLL3 protein with a histidine tag. The DLL3 protein standard curve and protein quantification assay were conducted as follows:

MSD standard plates were coated overnight at 4° C. with 15 μL of an anti-DLL3 monoclonal antibody at 4 μg/mL in PBS. Plates were washed in PBST and blocked in 35 μL MSD 3% Blocker A solution for one hour while shaking. Plates were again washed in PBST. 10 μL of 10× diluted lysate (or serially diluted recombinant DLL3 standard) in MSD 1% Blocker A containing 10% Protein Extraction Buffer was also added to the wells and incubated for two hours while shaking. Plates were again washed in PBST. An anti-DLL3 monoclonal antibody that recognizes a different epitope was sulfo-tagged using an MSD® SULFO-TAG NHS Ester according to the manufacturer's protocol. MSD SULFO-TAG NHS-Ester is an amine reactive, N-hydroxysuccinimide ester which readily couples to primary amine groups of proteins under mildly basic conditions to form a stable amide bond. 10 µL of the sulfo-tagged anti-DLL3 monoclonal antibody was added to the washed plates at 0.5 µg/mL in MSD 1% Blocker A for 1 hour at room temperature while shaking. Plates were washed in PBST. MSD Read Buffer T with surfactant was diluted to 1× in water and 35 µL was added to each well. Plates were read on an MSD Sector Imager 2400 using an integrated software analysis program to derive DLL3 concentrations in PDX samples via interpolation from the standard curve. Values were then divided by total protein concentration to yield nanograms of DLL3 per milligram of total lysate protein. The resulting concentrations are set forth in FIG. 8 wherein each spot represents the DLL3 protein concentrations of a single PDX tumor line or normal tissue sample. While each spot is derived from a single PDX line, in most cases multiple biological replicates were tested from the same PDX line and values were averaged to provide the data point.

Figure 8:
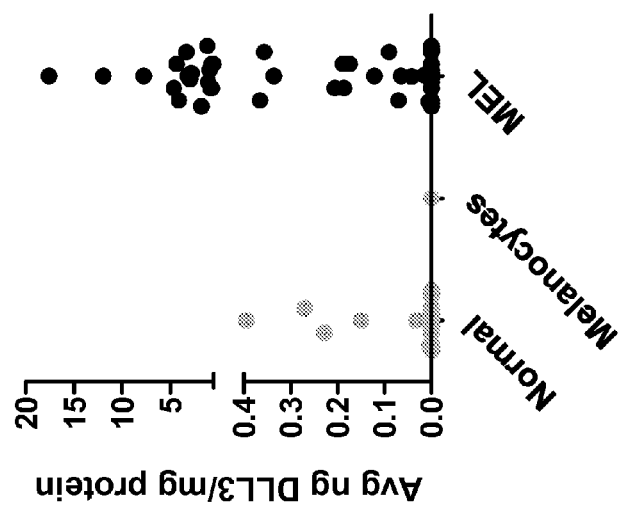
FIG. 8 shows the relative protein expression of human DLL3 measured using an electrochemiluminescent sandwich ELISA assay in normal tissues, cultured melanocytes and MEL PDX.

FIG. 8 shows that most normal tissues have no, or very low absolute protein expression of DLL3. Normal tissues that were tested included adrenal gland, artery, colon, esophagus, gall bladder, heart, kidney, liver, lung, peripheral and sciatic nerve, pancreas, skeletal muscle, skin, small intestine, spleen, stomach, trachea, red and white blood cells and platelets, bladder, brain, breast, eye, lymph node, ovary, pituitary gland, prostate and spinal cord. Additionally, a single sample of protein lysate from cultured melanocytes did not detectably express DLL3 protein despite the elevated mRNA expression detected by qRT-PCR in these cultured melanocytes (see Examples 1-2). Together, these observations indicate that DLL3 expression appears to be post-transcriptionally regulated in normal melanocytes. To determine if this post-transcriptional regulation was also seen in MEL, the MSD assay was performed on MEL PDX lysates. FIG. 8 shows that, of the MEL PDX lines tested, approximately 50% showed high expression of DLL3 protein, as defined relative to the index value of 0.59 ng DLL3/mg protein, the geometric mean of DLL3 expression in the PDX samples. For example, the MEL19 PDX cell line expressed 7.8 ng DLL3/mg protein, whereas an example of a PDX cell line that exhibited low expression of DLL was MEL6, which expressed only 0.54 ng DLL3/mg protein. The differential expression of DLL3 protein in MEL matches the differential expression of DLL3 mRNA observed by qRT-PCR and microarray (see Examples 1-3), indicating that in MEL, DLL3 is not post-transcriptionally regulated as it appears to be in normal melanocytes.

The clear differential expression of DLL3 protein in MEL PDX tumors compared to normal tissues, including melanocytes, strongly suggests that the DLL3 protein is an attractive target for therapeutic intervention using anti-DLL3 antibodies in a subset of melanoma tumors that express DLL3.

Example 14

Detection of DLL3 in Melanoma Tumors Using Immunohistochemistry

Immunohistochemistry (IHC) was performed on MEL PDX tumor tissue sections to assess the expression and location of DLL3 in MEL tumor cells.

In order to identify an IHC-compatible anti-DLL3 antibody, IHC was performed on HEK-293T parental cell pellets or DLL3-expressing HEK-293T cell pellets using numerous anti-DLL3 antibodies of the invention. IHC was performed, as described below, on HEK-293T cell pellets that were formalin fixed and paraffin embedded (FFPE) as is standard in the art. Planar sections of cell pellet blocks were cut and mounted on glass microscope slides. After xylene de-paraffinization 5 µm sections were pre-treated with Antigen Retrieval Solution (Dako) for 20 minutes at 99° C., cooled to 75° C. and then treated with 0.3% hydrogen peroxide in PBS followed by Avidin/Biotin Blocking Solution (Vector Laboratories). FFPE slides were then blocked with 10% horse serum in 3% BSA in PBS buffer and incubated with a primary monoclonal anti-DLL3 antibody of the invention, diluted to 10 µg/ml in 3% BSA/PBS, for 30 minutes at room temperature. FFPE slides were incubated with biotin-conjugated horse anti-mouse antibody (Vector Laboratories), diluted to 2.5 µg/ml in 3% BSA/PBS, for 30 minutes at room temperature followed by incubation in streptavidin-HRP (ABC Elite Kit; Vector Laboratories). Slides with primary tumor samples (p0) were further incubated in Tyramide Signal Amplification reagent (Perkin Elmer) at 1:25 for 4 minutes and then streptavidin-HRP for 30 minutes (Perkin Elmer). Chromogenic detection was developed with 3,3'-diaminobenzidine (Thermo Scientific) for 5 minutes at room temperature. Tissues were counterstained with Meyer's hematoxylin (IHC World), washed with alcohol and immersed in xylene.

An anti-DLL3 antibody able to specifically detect DLL3-overexpressing HEK-293T cell pellets more effectively than other anti-DLL3 antibodies of the invention that were tested was identified and used in further studies. The ability of the anti-DLL3 antibody to specifically detect DLL3 was confirmed by a competition experiment in which the antibody was mixed with a 5× molar ratio excess of hDLL3-His protein and then incubated with DLL3-expressing HEK-293T FFPE sections. The absence of positive staining demonstrated that the hDLL3-His protein interfered with the binding of the anti-DLL3 antibody to the DLL3-overexpressing HEK-293T cells (data not shown).

This anti-DLL3 antibody was then used to determine whether hDLL3 was expressed in various primary MEL biopsies and PDX tumor cell lines using IHC as described above. Staining intensity was scored from no staining (−) to high staining intensity (+++) based on a comparison of expression between the various MEL tumors and normal melanocytes. The percentage of cells that expressed hDLL3 is also noted. FIG. 9 demonstrates that DLL3 protein expression was seen on the membrane ("m") and/or in the cytoplasm ("c"), where "m/c" denotes predominant staining in the membrane and "c/m" denotes predominant staining in the cytoplasm. The following melanoma tumors expressed DLL3: MEL8, MEL17, MEL18, MEL19, MEL20, MEL30, MEL37, MEL48 and MEL66, which represent about half of the MEL PDX lines tested.

These data demonstrate that anti-DLL3 antibodies have diagnostic and therapeutic utility in melanoma.

Example 15

DLL3 Protein Expression on Tumors Using Flow Cytometry

Flow cytometry was used to assess the ability of the anti-DLL3 antibodies of the invention to specifically detect the presence of human DLL3 protein on the surface of MEL PDX tumor cell lines.

Figure 10A:
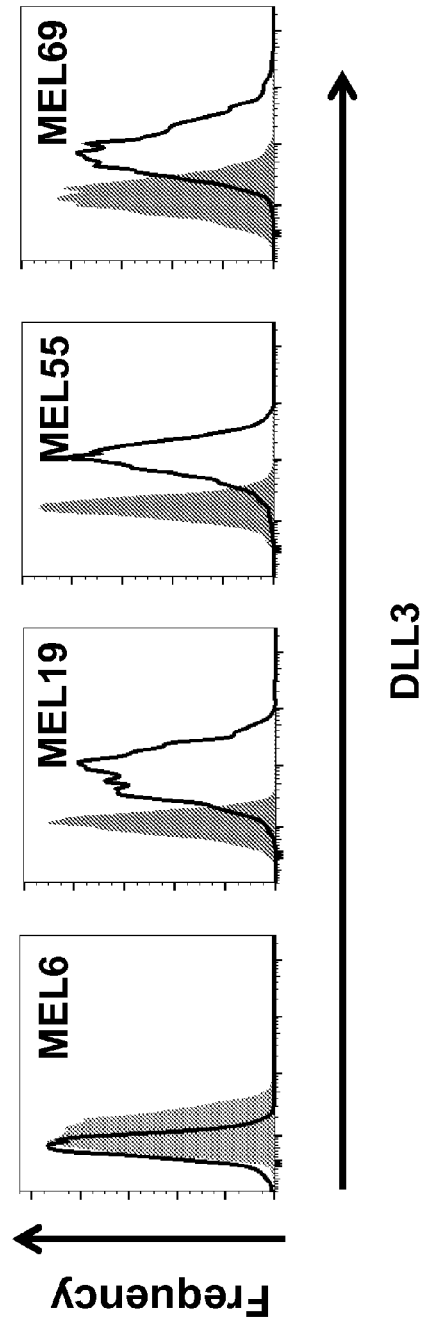
FIG. 10A shows surface protein expression of DLL3 (black line) in representative MEL PDX cell lines determined by flow cytometry compared to a fluorescence minus one (FMO) isotype-control stained population (solid gray).

MEL PDX tumors were harvested and dissociated using art-recognized enzymatic tissue digestion techniques to obtain single cell suspensions of PDX tumor cells (see, for example, U.S.P.N. 2007/0292414). The tumor cells were co-stained with commercially available anti-mouse CD45 and H-2K$^d$ antibodies. Mouse cells that stained positive for CD45 and H-2K$^d$ were excluded from the analysis. FIG. 10A shows that DLL3 expression was detected on various MEL PDX tumor lines (e.g. MEL19, MEL55, MEL69; black line), but not on others (e.g. MEL6; black line). Isotype control antibodies were employed to confirm staining specificity (gray-filled). This is in agreement with other results, for example, IHC staining showed a primary biopsy of MEL19 expresses DLL3 protein (FIG. 9), and the MSD assay showing that the MEL19 PDX cell line expresses high levels of DLL3 protein, compared to the MEL6 PDX cell line (Example 13).

Figure 10B:
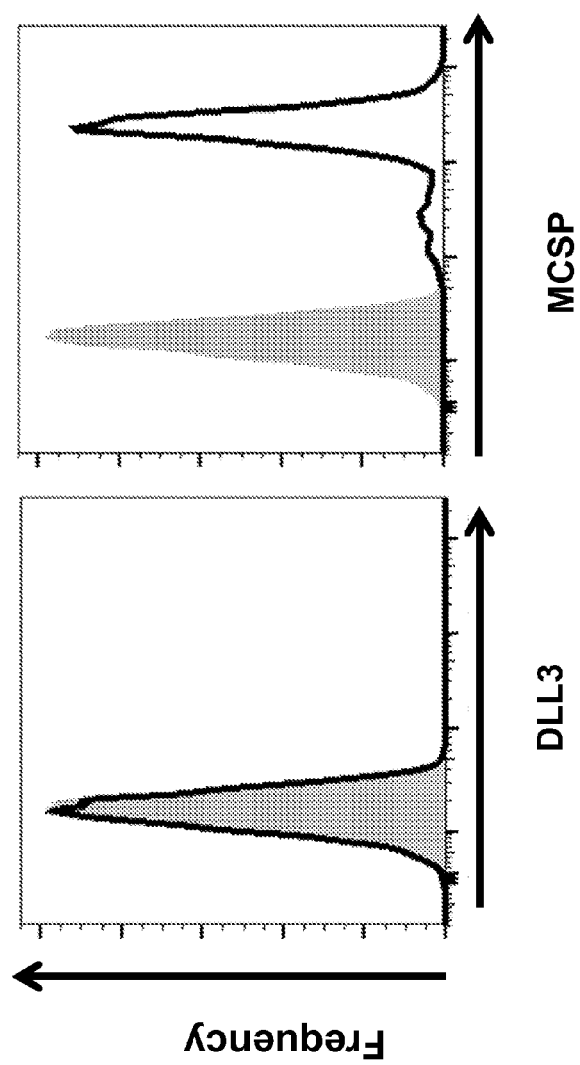
FIG. 10B shows surface protein expression of DLL3 or MCSP (black line) in cultured normal melanocytes determined by flow cytometry compared to a fluorescence minus one (FMO) isotype-control stained population (solid gray).

To corroborate the observation in Example 13 that normal melanocytes do not express DLL3 protein, flow cytometry, as described above, was performed on melanocytes expanded in vitro as described above. FIG. 10B clearly shows that DLL3 protein is not expressed on melanocytes (black line). As a positive control, to confirm the identity of the melanocytes, protein expression of Melanoma-associated Chondroitin Sulfate Proteoglycan (MCSP, also known as CSPG4; known to be expressed on melanocytes), was tested. The high expression of MCSP on the cultured melanocytes, as shown in FIG. 10B, confirmed both their identity and viability. Isotype control antibodies were further used to confirm staining specificity (gray-filled). This data shows that DLL3 protein is expressed on MEL tumors but is not expressed on normal melanocytes, consistent with the observations in Example 13. The differential expression of DLL3 on melanoma tumor cells, and not on normal melanocytes suggests that anti-DLL3 antibodies may constitute an excellent candidate therapy for the treatment of melanoma.

Example 16

Anti-DLL3 Antibodies Facilitate Delivery of Cytotoxic Agents In Vitro

To determine whether anti-DLL3 ADCs of the invention were able to internalize and mediate the delivery of cytotoxic agents to live tumor cells, an in vitro cell killing assay was performed using selected anti-DLL3 ADCs.

Figure 11A:
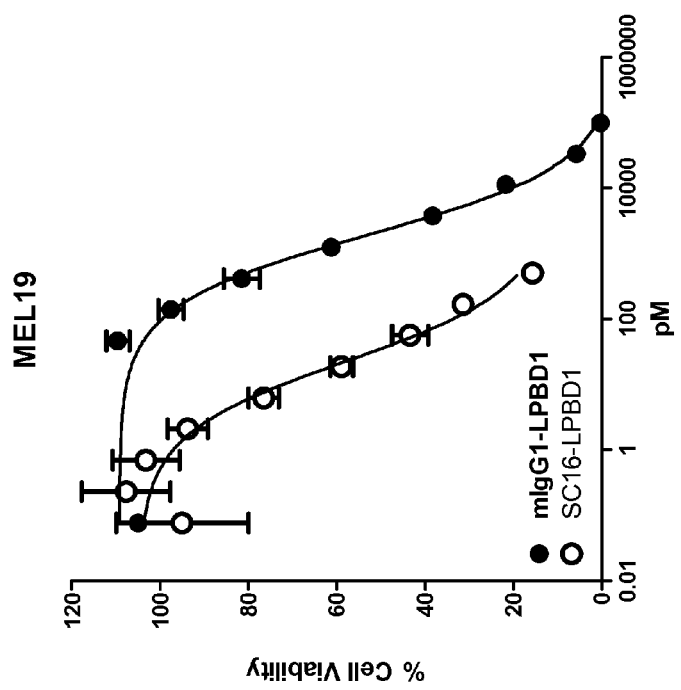
FIG. 11A shows the ability of selected conjugated anti-DLL3 antibodies to kill and/or suppress growth of MEL tumor cells in vitro.

Mouse lineage-depleted MEL PDX tumor cells (MEL19) were separated into single cell suspensions and plated into tissue culture plates. One day later, the tumor cells were exposed to humanized anti-DLL3 ADC, hSC16LPBD1 at various concentrations ranging from 0 pM to 500 pM or a mouse isotype control (mIgG1) conjugated to PBD1 (mIgG1-LPBD1) at various concentrations ranging from 0 nM to 100 nM. After incubation for 168 hours viable cells were enumerated using CellTiter-Glo® (Promega) as per the manufacturer's instructions. Raw luminescence counts using cultures containing untreated cells were set as 100% reference values and all other counts were calculated as a percentage of the reference value. Tumors that were exposed to SC16-LPBD1 showed a greater reduction in percent viable cells compared to the control mIgG1 ADC (FIG. 11A). While mIgG1 ADC is cytotoxic to cells at high concentrations, the anti-DLL3 ADC tested was more potent, indicating a response specific to DLL3 and not solely due to the PBD cytotoxin. The above results demonstrate the ability of anti-DLL3 ADCs to mediate internalization of the anti-DLL3 antibody and their ability to deliver cytotoxic payloads, supporting the hypothesis that anti-DLL3 antibodies may have therapeutic utility as the targeting moiety for an ADC.

Example 17

Anti-DLL3 Antibodies Suppress In Vivo Melanoma Growth

The anti-DLL3 ADCs, generated as described in Example 10 above, were tested to demonstrate their ability to kill and suppress melanoma growth in immunodeficient mice.

Figures 11B, 11C:
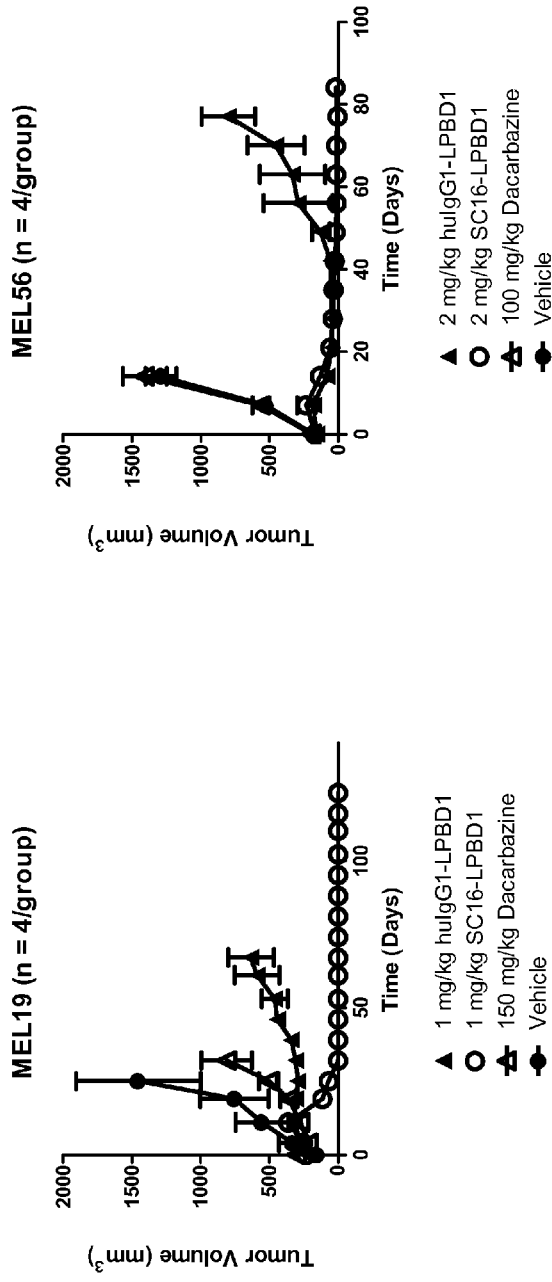
FIGS. 11B-11E show the ability of selected anti-DLL3 antibody drug conjugates or standard of care dacarbazine to kill and/or suppress growth of MEL tumor cells in vivo.
Figures 11D, 11E:
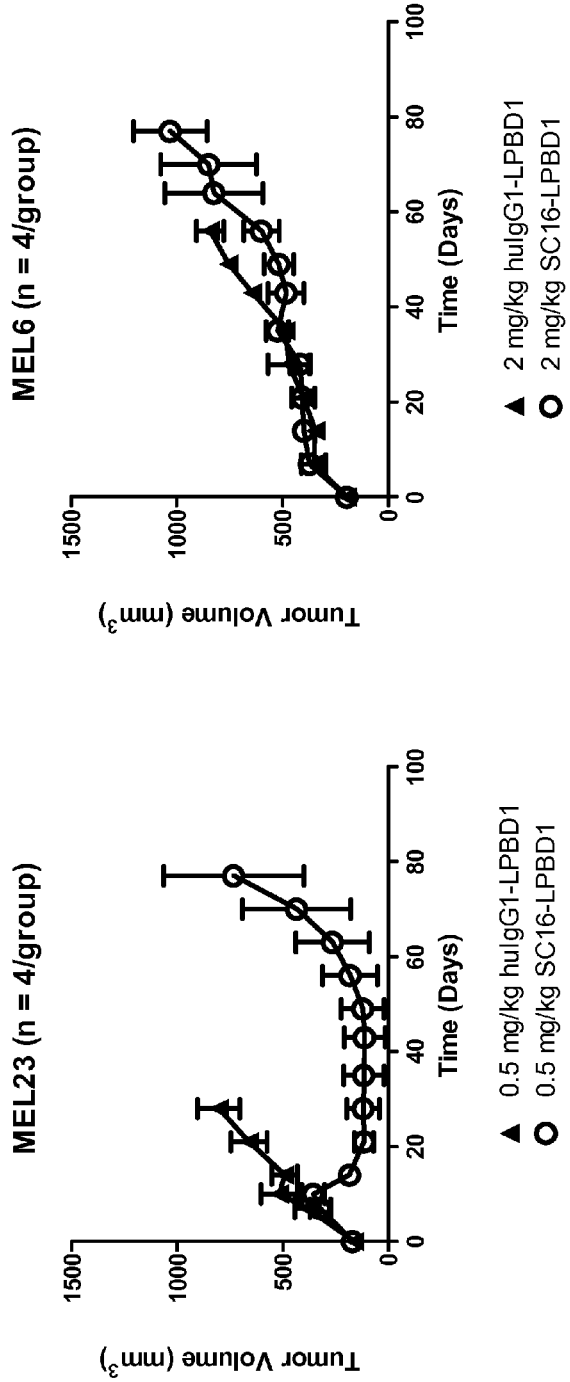

MEL PDX tumor lines were grown subcutaneously in the flanks of female NOD/SCID mice using art-recognized techniques. Tumor volumes and mouse weights were monitored once or twice per week. When tumor volumes reached 150-250 mm$^3$, mice were randomly assigned to treatment groups and injected intraperitoneally with SC16-LPBD1 (see Example 10) or an anti-hapten control human IgG1-LPBD1. Following treatment, tumor volumes and mouse weights were monitored until tumors exceeded 800 mm$^3$ or mice became sick. Mice treated with SC16-LPBD1 did not exhibit any adverse health effects beyond those typically seen in immunodeficient, tumor-bearing NOD/SCID mice. Mice bearing MEL19 tumors were given a total of 3 doses of SC16-LPBD1 at 1 mg/kg each, every four days over a period of two weeks, which resulted in tumor suppression lasting over 120 days post-treatment (FIG. 11B) In contrast, MEL19-bearing mice treated with a single dose of the standard of care drug dacarbazine at 150 mg/kg, did not exhibit significant reductions in tumor burden (FIG. 11B). Mice bearing MEL56 were treated with a single dose of hSC16-LPBD1 at 2 mg/kg or dacarbazine at 100 mg/kg. MEL56 proved refractory to dacarbazine and only temporarily responsive to the IgG control, whereas hSC16-LPBD1 durably inhibited in vivo growth, with remission lasting over 80 days post-treatment (FIG. 11C). Mice bearing MEL23 tumors were treated with a total of 3 doses of hSC16-LPBD1 at 0.5 mg/kg each, every four days over a period of two weeks, which resulted in tumor suppression lasting over 50 days (FIG. 11D). As a negative control and to demonstrate the specificity of hSC16-LPBD1 to tumors expressing DLL3, mice bearing the PDX tumor MEL6, which does not express DLL3 (see FIG. 10A), were treated with hSC16-LPBD1. MEL6 tumor-bearing mice were treated with a single dose of hSC16-LPBD1 at 2 mg/kg, which resulted in no inhibition of tumor growth over that seen with the IgG1-LPBD1 control (FIG. 11E).

Additionally, MEL3, a stage HA, non-metastatic melanoma tumor that was refractory to treatment with 300 mg/kg dacarbazine, expressed DLL3 (FIG. 1) and responded to treatment with hSC16-LPBD1 in vivo (data not shown). This further demonstrates the utility of treating non-metastatic melanoma patients that express DLL3 with anti-DLL3 therapies and the utility of anti-DLL3 ADCs in the treatment of refractory melanoma.

The ability of hSC16-LPBD1 to specifically kill DLL3-expressing melanoma tumor cells and dramatically suppress melanoma growth in vivo for extended periods compared to standard of care dacarbazine further validates the use of anti-DLL3 ADCs in the therapeutic treatment of human melanoma.

Example 18

Surrogate Biomarkers of DLL3 Expression in Melanoma

Figure 12C:
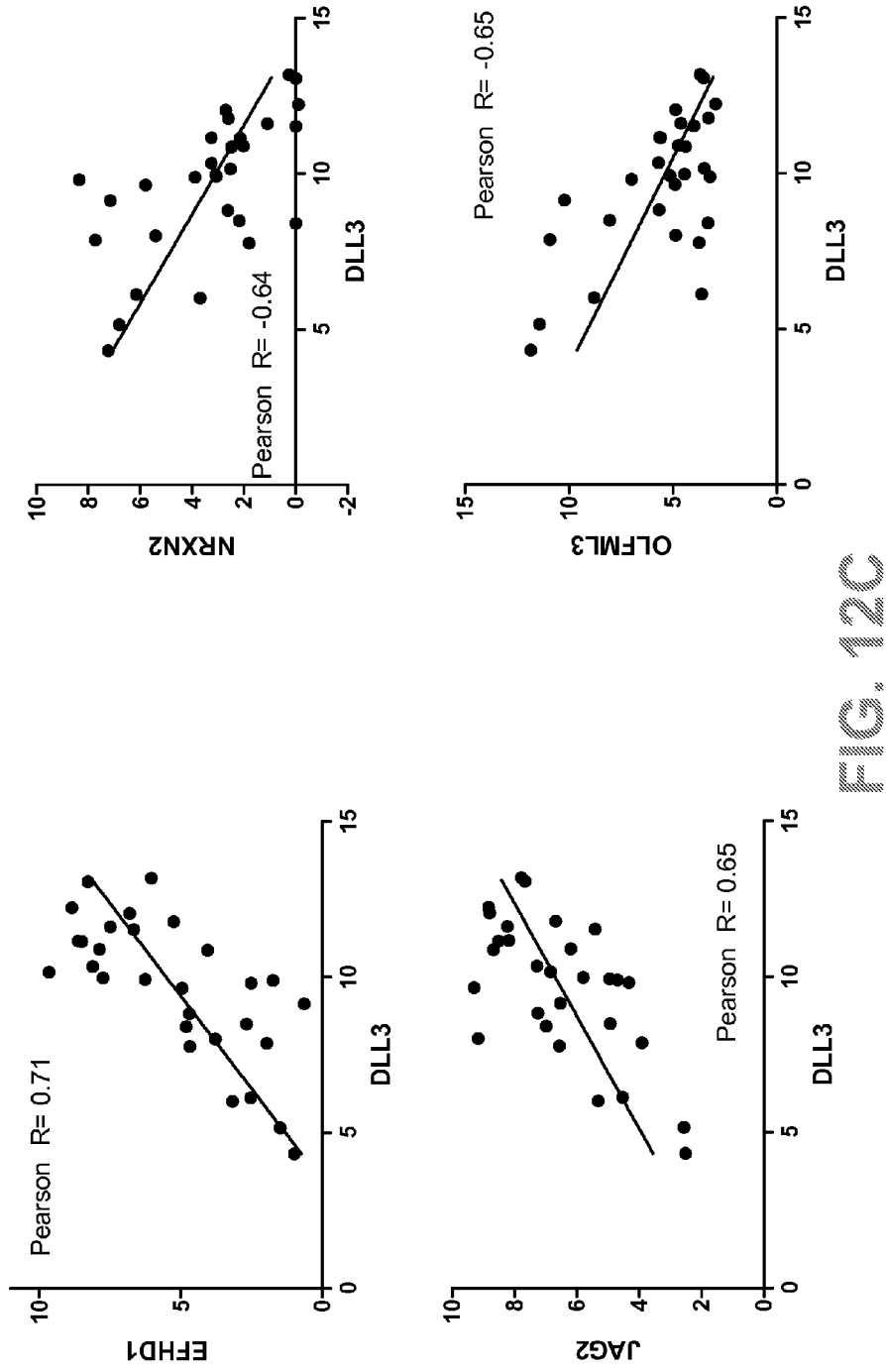
FIG. 12C shows the plots of four surrogate biomarkers, two that are correlative (e.g. EFHD1 and JAG2) and two that are anti-correlative (e.g. NRXN2 or OLFML3) with DLL3.

Surrogate biomarkers of DLL3 expression were discovered based on their positive correlation or negative correlation (anti-correlation) with DLL3 mRNA expression detected using microarray. Microarray data was obtained, as described above in Example 3, for 34,021 probes that map to 21,440 genes with official gene symbols, as annotated in the Reference Sequence database (RefSeq). The Pearson correlation coefficient was determined between expression of DLL3 and the expression of each other gene in various MEL PDX cell lines. Genes having a positive correlation with DLL3 i.e. having a Pearson correlation of 0.6 or greater in magnitude are listed in FIG. 12A; and genes which are anti-correlative with DLL3 i.e. having a Pearson correlation of −0.6 or less are listed in FIG. 12B. FIG. 12C shows examples of genes whose expression is positively correlated (e.g. EFHD1 and JAG2) or anti-correlated (NRXN2 and OLFML3) with DLL3. The normalized intensity value of the selected gene and DLL3 are plotted for each MEL PDX sample. The best fit linear trend line and corresponding Pearson correlation value are displayed in each panel. Based on the sequences of some of the genes in FIG. 12C it is hypothesized that their corresponding proteins, are likely secreted extracellularly, and thus detectable in blood, plasma, and/or serum. Specifically, OLFML3 has been published to be secreted (Zeng L C et al 2004 FEBS Lett). EFHD1 was inferred to be associated with extracellular vesicular exosomes (Prunotto M et al 2013 J Proteomics), and thus might be released into the extracellular region and detectable in serum. Similar to DLL3, JAG2 is associated with the NOTCH signaling pathway and a high correlation of DLL3 and JAG2 co-expression in melanoma samples can be a further biomarker of melanomas that are amenable to treatment with anti-DLL3 antibody therapies. NRXN2 is a single pass type I membrane protein and two different microarrays to this mRNA transcript showed significant anti-correlative expression with DLL3. This data demonstrates that mRNA expression of various genes can be used as correlative or anti-correlative surrogate biomarkers for DLL3 expression, and as a result of their predicted secretion may be detectable in bodily fluids.

Example 19

Correlation Between DLL3 Expression and Genetic Mutations of Various Oncogenes or Tumor Suppressor Genes in Melanoma The V600E BRAF mutation is found in 40-70% of malignant melanoma tumors. Vemurafenib is a specific inhibitor with 30-fold selectivity for mutated BRAF. While patients with the V600E BRAF mutation show a 70% response rate to vemurafenib, with tumor regression and improved survival, acquired resistance frequently occurs after several months of treatment through mutations leading to MAP kinase pathway (re)activation. Therefore, novel combination therapies that might replace or be combined with vemurafenib in BRAF-mutated patients are needed, as well as treatment for melanoma patients with tumors that have wild-type BRAF.

To determine whether BRAF is mutated in select MEL PDX, genomic DNA (gDNA) was isolated from MEL PDX using the DNA Wiz (Promega), DNeasy (Qiagen) or AllPrep kit (Qiagen) after depletion of mouse cells, as described in Example 1 and wild type or V600E BRAF alleles were detected by competitive qRT-PCR using the Taqman Mutation Detection assay (Life Technolgoies) with BRAF_475_mu and Hs00000172_rf TaqMan primer/probe sets using an ABI7900 thermocycler. Internal positive reference controls were included as is standard in the field.

Germ-line mutations were determined in 16 MEL PDX cell lines to determine BRAF mutation status. The V600E BRAF mutation was found in 6 out of 16 MEL PDX cell lines tested, in agreement with published mutation frequency in MEL tumors (Davies et al., 2002, PMID: 12068308; Thomas et al., 2004, PMID: 15140228; Edlundh et al., 2006, PMID: 17119447, Thomas et al., 2007, PMID: 17507627.) Surprisingly, there was no correlation between DLL3 expression and expression of the V600E BRAF mutation in melanoma tumors; 3 out of 6 MEL PDX cell lines with the V600E BRAF mutation had high DLL3 expression (data not shown). In addition, 6 out of the 10 MEL PDX cell lines expressing wild-type BRAF also had high DLL3 expression (data not shown). For example, MEL19 has the V600E BRAF mutation, while MEL23 lacks the V600E BRAF mutation and both PDX cell lines responded to anti-DLL3 ADC treatment in vivo (FIGS. 11A and 11C). Therefore, the disclosed anti-DLL3 therapies will be useful in treating both wild type BRAF and V600E BRAF mutated metastatic melanoma.

To extend the analysis of a correlation between DLL3 expression with mutations in oncogenes and tumor suppressor genes commonly mutated in melanoma, gDNA from 32 MEL PDX samples were subjected to next generation sequencing on the Ion Torrent Personal Genome Machine (PGM). 10 ng of gDNA as determined by quantification with the TaqMan RNase P Detection Reagent (Ion Torrent) was used from each MEL PDX. Genomic regions of interest were amplified with custom Ion AmpliSeq primer pools (Ion Torrent) according to the manufactures' recommended protocols. Following target amplification, individual barcodes and sequencing adapters were ligated to individual MEL PDX samples. The libraries were quantified using the Ion Library Quantitation Kit (Ion Torrent) and equal concentrations of each MEL PDX library was pooled in groups of four barcoded libraries for sequencing. Enrichment of template-positive Ion Sphere Particles (ISPs) for 200 base-read sequencing from pools of 4 barcoded libraries were prepared according to manufacturers' protocols using the Ion PGM Template OT2 200 kit on the Ion OneTouch2 or the Ion PGM IC 200 Kit on the Ion Chef (Ion Torrent). Sequencing was done using the Ion PGM Sequencing 200 Kit v2 or the Ion PGM IC 200 Kit on a Ion 318 Chip v2 (Ion Torrent) using the Ion Torrent PGM.

Using this targeted sequencing approach, it was found that 14/32 (44%) of the MEL PDX tested, had mutated BRAF (12=V600E, 1=V600K, 1=V600R), in line with published mutation rates and in agreement with previous findings using a Taqman assay to differentiate wild-type and mutated BRAF. There was no correlation between DLL3 expression and expression of the V600E BRAF mutation in melanoma tumors; of the 14 MEL PDX cell lines with high expression of DLL3, 4 had the V600E BRAF mutation and 1 had the V600R mutation (FIG. 13). In addition, of the 18 MEL PDX cell lines with low or no expression of DLL3, 8 had the V600E BRAF mutation and 1 had the V600K mutation (FIG. 13). Therefore, the disclosed anti-DLL3 therapies will be useful in treating both wild type BRAF and V600E BRAF mutated melanoma that expresses DLL3, either in combination, or as a stand alone therapy.

Other oncogenes mutated in melanoma amenable to targeted therapies include NRAS, PIK3CA and KIT. As show in FIG. 13, MEL PDX that expression DLL3 can have mutations in NRAS, PIK3CA or KIT, suggesting possible combination therapies with anti-DLL3 antibodies and inhibitors of the constitutively active oncogenes.

Point mutations or copy number variation (CNV) with loss of one or both alleles were detected for several tumor suppressor genes often mutated in melanoma, including TP53, CDKN2A and PTEN. Again, there was no correlation between loss of key tumor suppressor genes and expression of DLL3. MEL23 which expresses DLL3 and has wild-type BRAF, has inactivating point mutations in both TP53 and PTEN, but as show in FIG. 11D, is responsive to anti-DLL3 ADC treatment in vivo. Therefore, the disclosed anti-DLL3 therapies will be useful in treating metastatic melanoma that expresses DLL3 in the context of loss of function of multiple tumor suppressor genes.

Taken together, these data together suggest that melanomas which express DLL3 do so independently of the most commonly annotated mutations of oncogenes and tumor suppressors in melanoma. These data would imply the possibility of treating melanoma patients who are also being treated with targeted agents (for example, vemurafenib, trametinib, dasatinib).

Example 20

DLL3 Antibody Drug Conjugates for Targeting of Cancer Stem Cells

DLL3 expression is associated with cancer stem cells that are generally known to be both drug resistant and fuel tumor recurrence and metastasis (WO/2013/126746). To demonstrate that treatment with anti-DLL3 ADCs reduces the frequency of tumorigenic cells in melanoma tumors, in vivo limiting dilution assays were performed following treatment with SC16-LPBD1.

Figure 14A:
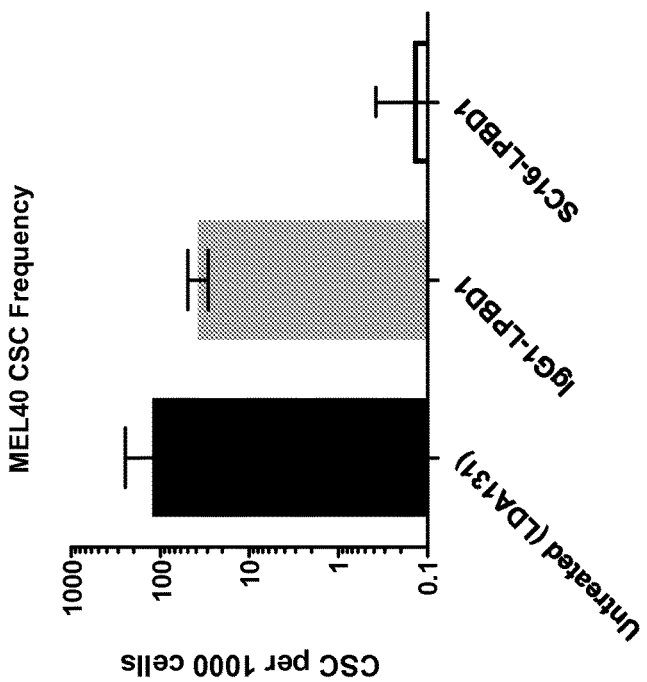
FIG. 14A depicts the reduction of tumor volume in the presence of the anti-DLL3 ADC SC16-LPBD1 and FIG. 14B shows that MEL tumor cells treated with SC16-LPBD1 exhibited a reduced frequency of cancer stem cells compared to those MEL tumors treated with either IgG1 conjugated to PBD1 or untreated tumors based on a limited dilution assay and analysis using Poisson distribution statistics.

MEL PDX tumor (e.g. MEL40) was grown subcutaneously in six immunocompromised host mice. When tumor volumes averaged 150 mm$^3$-250 mm$^3$, the mice were randomly segregated into three groups of two mice each. Mice were injected intraperitoneally on days 0, 4 and 7, with either vehicle control, an anti-hapten control human IgG1-LPBD1 or SC16-LPBD1 (see Example 10) at a dose of 1 mg/kg. On day 8, two representative mice from each group were euthanized and the tumors were harvested and dispersed to single-cell suspensions. The tumors in the remaining four mice that were treated with the isotype control continued to grow, whereas the volumes of the tumors treated with SC16-LPBD1 were reduced to zero or nearly zero. An additional control shows that the tumors of mice treated with vehicle also continued to grow (FIG. 14A).

Tumor cells from each of the two treatment groups were then pooled and live human cells were isolated from the surrounding murine cells by FACS using a FACSAria III (Becton Dickenson) as follows. Tumor cells were labelled with FITC-conjugated anti-murine H2Kd and anti-murine CD45 antibodies (BioLegend) and then resuspended in 1 µg/ml DAPI (to detect dead cells). The resulting suspension was then sorted under standard conditions. Live human cells were collected, while murine and dead cells were discarded.

Figure 14B:
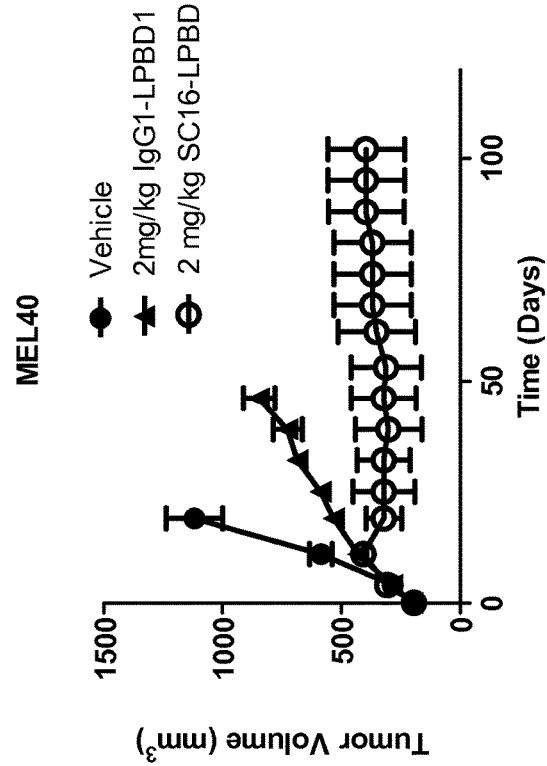

Five recipient mice were transplanted with 200, 50, 12 or 3 sorted live human cells from tumors treated with SC16-LPBD1. For comparison, five recipient mice were transplanted with 100, 30, 15 or 5 sorted live human cells from tumors treated with IgG1-LPBD1. Additionally, in a previous study, LDA131, untreated MEL40 cells were sorted and 700, 70 and 7 live human cells were transplanted into 5 recipient mice each. Tumors in recipient mice were measured weekly, and individual mice were euthanized before tumors reached 1500 mm$^3$. The study was ended after four consecutive weeks without a new tumor appearing in any one mouse. At that time, recipient mice were scored as positive or negative for tumor growth, with positive growth having volumes exceeding 200 mm$^3$. Melanoma tumor-bearing mice that were treated with the IgG1-LPBD1 control developed many more tumors than melanoma tumor-bearing mice treated with SC16-LPBD1. Using Poisson distribution statistics (L-Calc software, Stemcell Technologies), the frequencies of cancer stem cells in each population was determined. Cancer stem cell frequency in hSC16-LPBD1 treated mice was reduced to fewer than 1 in 1000 cells compared to about 1 in 40 cell for isotype-treated mice or about 1 in 10 cells for untreated treated mice (FIG. 14B). The results indicate that, in addition to reducing melanoma tumor volume, the anti-DLL3 ADCs of the invention significantly and specifically reduce cancer stem cell populations and, by extension, they would also reduce recurrence, metastasis or re-growth of melanoma tumors.

SEQUENCE LISTING (437 sequences)

SEQ ID NO: 1 - protein, 618 aa, Homo sapiens
MVSPRMSGLLSQTVILALIFLPQTRPAGVFELQIHSFGPGPGPGAPRSPCSARLPCRLFFRVCLKPGLSEEAAESPCALGAALSARGPVYTEQPGAPAPDLPLPDGLLQVPFRDAWPGTFSFIIETWREELGDQIGGPAWSLLARVAGRRRLAAGGPWARDIQRAGAWELRFSYRARCEPPAVGTACTRLCRPRSAPSRCGPGLRPCAPLEDECEAPLVCRAGCSPEHGFCEQPGECRCLEGWTGPLCTVPVSTSSCLSPRGPSSATTGCLVPGPGPCDGNPCANGGSCSETPRSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYLLPPALGLLVAAGVAGAALLLVHVRRRGHSQDAGSRLLAGTPEPSVHALPDALNNLRTQEGSGDGPSSSVDWNRPEDVDPQGIYVISAPSIYAREVATPLFPPLHTGRAGQRQHLLFPYPSSILSVK

SEQ ID NO: 2 - protein, 587 aa, Homo sapiens
MVSPRMSGLLSQTVILALIFLPQTRPAGVFELQIHSFGPGPGPGAPRSPCSARLPCRLFFRVCLKPGLSEEAAESPCALGAALSARGPVYTEQPGAPAPDLPLPDGLLQVPFRDAWPGTFSFIIETWREELGDQIGGPAWSLLARVAGRRRLAAGGPWARDIQRAGAWELRFSYRARCEPPAVGTACTRLCRPRSAPSRCGPGLRPCAPLEDECEAPLVCRAGCSPEHGFCEQPGECRCLEGWTGPLCTVPVSTSSCLSPRGPSSATTGCLVPGPGPCDGNPCANGGSCSETPRSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYLLPPALGLLVAAGVAGAALLLVHVRRRGHSQDAGSRLLAGTPEPSVHALPDALNNLRTQEGSGDGPSSSVDWNRPEDVDPQGIYVISAPSIYAREA

SEQ ID NO: 3 - protein, 5 aa, Homo sapiens
QPGAP

SEQ ID NO: 4 - protein, 4 aa, Homo sapiens
  misc_feature (2)..(2): Xaa can be any naturally occurring amino acid
GXRP

SEQ ID NO: 5 - protein, 107 aa, Homo sapiens [sequence omitted]

SEQ ID NO: 6 - protein, 329 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 7 - protein, 329 aa, Homo sapiens
  MISC_FEATURE: C220S IgG1 heavy constant region
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 8 - protein, 328 aa, Homo sapiens
  MISC_FEATURE: C220? IgG1 heavy constant region
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 9 - protein, 106 aa, Homo sapiens
  MISC_FEATURE: C214? Kappa light chain constant region
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGE

SEQ ID NO: 10 - protein, 107 aa, Homo sapiens
  MISC_FEATURE: C214S Kappa light chain constant region
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGES

SEQ ID NO: 11 - protein, 105 aa, Homo sapiens
  MISC_FEATURE: Lambda light chain constant region
QPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 12 - protein, 104 aa, Homo sapiens
  MISC_FEATURE: C214? Lambda light chain constant region
QPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTES

SEQ ID NO: 13 - protein, 105 aa, Homo sapiens
  MISC_FEATURE: C214S Lambda light chain constant region
QPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTESS

SEQ ID NO: 14 - protein, 214 aa, Mus musculus
  MISC_FEATURE: SC16.56 ss1 and ss2 full length light chain
EIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15 - protein, 447 aa, Mus musculus
  MISC_FEATURE: SC16.56 ss3 and ss4 full length heavy chain
QVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 16 - protein, 447 aa, Mus musculus
  MISC_FEATURE: SC16.56 ss1 full length heavy chain
QVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 17 - protein, 446 aa, Mus musculus
  MISC_FEATURE: SC16.56 ss2 full length heavy chain
QVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 18 - protein, 213 aa, Mus musculus
  MISC_FEATURE: SC16.56 ss3 full length light chain
EIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGE

SEQ ID NO: 19 - protein, 214 aa, Mus musculus
  MISC_FEATURE: SC16.56 ss4 full length light chain
EIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGES

SEQ ID NO: 20 - DNA, 324 bp, Mus musculus
  misc_feature (1)..(324): SC16.3 VL
  CDS (1)..(324)
caaattgttctcacccagtctccagcaatcatgtctgtatctctaggggaacgggtcaccatgacctgcactgccagctcaagtgtaagttccagttacttgcactggtaccaacaaaagccaggatcctcccccaaactctggatttatagcacatccaacctggcttctggagtcccagctcgcttcagtggcagtgggtctgggacctcttattttttcacaatcagcagcatggaggctgaagatgctgccacttattactgccaccagtatcatcgttccccattcacgttcggcgcggggacaaagttgaaaataaga

SEQ ID NO: 21 - protein, 108 aa, Mus musculus
QIVLTQSPAIMSVSLGERVTMTCTASSSVSSSYLHWYQQKPGSSPKLWIYSTSNLASGVPARFSGSGSGTSYFFTISSMEAEDAATYYCHQYHRSPFTFGAGTKLKIR

SEQ ID NO: 22 - DNA, 369 bp, Mus musculus
  misc_feature (1)..(369): SC16.3 VH
  CDS (1)..(369)
caggttactctgaaagagtctggccctgggatattgcagccctcccagaccctcagtctgacttgttctttctctgggttttcactgagcacttctggtatgggtgtaggctggattcgtcagccatcagggaagggtctggagtggctggcacacatttggtgggatgatgtcaagcgctataacccagccctgaagagccgactaactatctccaaggatacctccagcagccaggtattcctcaagatcgccagtgtggacactgcagatactgccacatactactgtgctcgaatagctgactatggcggagattactatgctatggactactggggtcaaggaacctcagtcaccgtctcctca

SEQ ID NO: 23 - protein, 123 aa, Mus musculus
QVTLKESGPGILQPSQTLSLTCSFSGFSLSTSGMGVGWIRQPSGKGLEWLAHIWWDDVKRYNPALKSRLTISKDTSSSQVFLKIASVDTADTATYYCARIADYGGDYYAMDYWGQGTSVTVSS

SEQ ID NO: 24 - DNA, 321 bp, Mus musculus
  misc_feature (1)..(321): SC16.4 VL
  CDS (1)..(321)
gatatccagatgacacagactacatcttccctgtctgcctctctgggagacagagtcaccatcagttgcagggcaagtcaggacattagcaattatttaaactggtatcagcagaaaccagatggaactgttaaactcctgatctactacacatcaagattacactcaggcgtcccatcaaggttcagtggcagtgggtctggaacagattattctctcaccattagcaacctggagctagaagatattgccacttacttttgccaacagggtgatatgcttccgtggacgttcggtggaggcaccaagctggaaatcaaa

SEQ ID NO: 25 - protein, 107 aa, Mus musculus
DIQMTQTTSSLSASLGDRVTISCRASQDISNYLNWYQQKPDGTVKLLIYYTSRLHSGVPSRFSGSGSGTDYSLTISNLELEDIATYFCQQGDMLPWTFGGGTKLEIK

SEQ ID NO: 26 - DNA, 351 bp, Mus musculus
  misc_feature (1)..(351): SC16.4 VH
  CDS (1)..(351)
cagatccagttggtgcagtctggacctgagctgaagaagcctggagagacagtcaagatctcctgcaaggcttctggttataccttcacagactattcaatgcactgggtgaagcaggctccaggaaagggtttaaagtggatgggctggataaacactgagactggtgagccaggatatgcagatgacttcaagggacggtttgccttctctttggaaacctctgccagcactgcctatttgcagatcaacaacctcaaaaatgaggacacggctacatatttctgtgctcggtacgacgggtatgctatggactattggggtcaaggaacctcagtcaccgtctcctca

SEQ ID NO: 27 - protein, 117 aa, Mus musculus
QIQLVQSGPELKKPGETVKISCKASGYTFTDYSMHWVKQAPGKGLKWMGWINTETGEPGYADDFKGRFAFSLETSASTAYLQINNLKNEDTATYFCARYDGYAMDYWGQGTSVTVSS

SEQ ID NO: 28 - DNA, 318 bp, Mus musculus
  misc_feature (1)..(318): SC16.5 VL
  CDS (1)..(318)
caaattgttctcacccagtctccagcaatcatgtctgcatctccaggggagaaggtcaccatgacctgcagtgccagctcaagtgtaagttacatgcactggtaccagcagaagtcaggcacctcccccaaaagatggatttatgacacatccaaactggcttctggagtccctgctcgcttcagtggcagtgggtctgggacctcttactctctcacaatcagcagcatggaggctgaagatgctgccacttattactgccagcagtggactagaaacccgctcacgttcggggctggaaccaagctggagctgaaa

SEQ ID NO: 29 - protein, 106 aa, Mus musculus
QIVLTQSPAIMSASPGEKVTMTCSASSSVSYMHWYQQKSGTSPKRWIYDTSKLASGVPARFSGSGSGTSYSLTISSMEAEDAATYYCQQWTRNPLTFGAGTKLELK

SEQ ID NO: 30 - DNA, 372 bp, Mus musculus
  misc_feature (1)..(372): SC16.5 VH
  CDS (1)..(372)
caggttactctgaaagagtctggccctgggatattgcagccctcccagaccctcagtctgacttgttctttctctgggttttcactgagcacttctggtatgggtgtaggctggattcgtcagccttcaggagagggtctagagtggctggcagacatttggtgggatgacaataagtactataacccatccctgaagagccggctcacaatctccaaggatacctccagcaaccaggtattcctcaagatcaccagtgtggacactgcagatactgccacttactactgtgctcgaagagttaactatgtttacgacccgtactatgctatggactactggggtcaaggaacctcagtcaccgtctcctca

SEQ ID NO: 31 - protein, 124 aa, Mus musculus
QVTLKESGPGILQPSQTLSLTCSFSGFSLSTSGMGVGWIRQPSGEGLEWLADIWWDDNKYYNPSLKSRLTISKDTSSNQVFLKITSVDTADTATYYCARRVNYVYDPYYAMDYWGQGTSVTVSS

SEQ ID NO: 32 - DNA, 336 bp, Mus musculus
  misc_feature (1)..(336): SC16.7 VL
  CDS (1)..(336)
aacattatgatgacacagtcgccatcatctctggctgtgtctgcaggagaaaaggtcactatgagctgtaagtccagtcaaagtgttttatacagttcaaatcagaagaactacttggcctggtaccaacagaaaccagggcagtctcctaaactgctgatctactgggcatccactagggaatctggtgtccctgatcgcttcacaggcagtggatctgggacagattttactcttaccatcagcactgtacaagttgaagacctggcagtttattactgtcatcaatacctctcctcgtggacgttcggtggaggcaccaagctggaaatcaaa

SEQ ID NO: 33 - protein, 112 aa, Mus musculus
NIMMTQSPSSLAVSAGEKVTMSCKSSQSVLYSSNQKNYLAWYQQKPGQSPKLLIYWASTRESGVPDRFTGSGSGTDFTLTISTVQVEDLAVYYCHQYLSSWTFGGGTKLEIK

SEQ ID NO: 34 - DNA, 357 bp, Mus musculus
  misc_feature (1)..(357): SC16.7 VH
  CDS (1)..(357)
gaggtccagctgcaacagtctggacctgagctggtgaagcctggggcttcagtgaagatttcctgcaaggcttctggttactcattcactggctataaaatgcactgggtgaagcaaagccatgtaaagagccttgagtggattggacgtattaatccttacaatggtgctactagctacaaccagaatttcaaggacaaggccaccttgactgtagataagtcctccagcacagcctacatggacctccacagcctgacatctgaggactctgcagtctatttctgtgcaagaggggactataggtacgactggtttgcttactggggccaagggactctggtcactgtctctgca

SEQ ID NO: 35 - protein, 119 aa, Mus musculus
EVQLQQSGPELVKPGASVKISCKASGYSFTGYKMHWVKQSHVKSLEWIGRINPYNGATSYNQNFKDKATLTVDKSSSTAYMDLHSLTSEDSAVYFCARGDYRYDWFAYWGQGTLVTVSA

SEQ ID NO: 36 - DNA, 321 bp, Mus musculus
  misc_feature (1)..(321): SC16.8 VL
  CDS (1)..(321)
gaaatccagatgacccagtctccatcctctatgtctgcatctctgggagacagaataaccatcacttgccaggcaactcaagacattgttaagaatttaaactggtatcagcagaaaccagggaaacccccttcattcctgatctattatgcaattgaactggcagaaggggtcccatcaaggttcagtggcagtgggtctgggtcagactattctctgacaatcagcaacctggagtctgaagattttgcagactattactgtctacagttttatgagtttccgttcacgttcggtgctgggaccaagctggagctgaaa

SEQ ID NO: 37 - protein, 107 aa, Mus musculus
EIQMTQSPSSMSASLGDRITITCQATQDIVKNLNWYQQKPGKPPSFLIYYAIELAEGVPSRFSGSGSGSDYSLTISNLESEDFADYYCLQFYEFPFTFGAGTKLELK

SEQ ID NO: 38 - DNA, 363 bp, Mus musculus
  misc_feature (1)..(363): SC16.8 VH
  CDS (1)..(363)
caggcccagctgcagcagtctggagctgagctggtaaggcctgggacttcagtgaaggtgtcctgcaaggcttctggatacgccttcactaattacttgatagagtgggtaaagcagaggcctggacagggccttgagtggattggagtgattaatcctggaactggtggtactaactacaatgagaacttcaagggcaaggcaactctgactgcagacaaatcctccagtactgcctacatgcagctcagcagcctgacatctgatgactctgcggtctatttctgtgcaagatccccctatgattaccacgagggtgctatggactactggggtcaaggaacctcagtcaccgtctcctca

SEQ ID NO: 39 - protein, 121 aa, Mus musculus
QAQLQQSGAELVRPGTSVKVSCKASGYAFTNYLIEWVKQRPGQGLEWIGVINPGTGGTNYNENFKGKATLTADKSSSTAYMQLSSLTSDDSAVYFCARSPYDYHEGAMDYWGQGTSVTVSS

SEQ ID NO: 40 - DNA, 324 bp, Mus musculus
  misc_feature (1)..(324): SC16.10 VL
  CDS (1)..(324)
caaattgttctcacccagtctccagcaatcatgtctgcatctctaggggaacgggtcaccatgacctgcactgccagctcaagtgtaagttccagttacttgcactggtaccagcagaagccaggatcatcccccaaactctggatttatagcacttccaacctggcttctggagtcccaactcgcttcagtggcagtgggtctgggacctcttactctctcacaatcagcagcatggaggctgaagatgctgccacttattactgccaccagtatcatcgttccccattcacgttcggctcggggacaaagttggaaataaaa

SEQ ID NO: 41 - protein, 108 aa, Mus musculus
QIVLTQSPAIMSASLGERVTMTCTASSSVSSSYLHWYQQKPGSSPKLWIYSTSNLASGVPTRFSGSGSGTSYSLTISSMEAEDAATYYCHQYHRSPFTFGSGTKLEIK

SEQ ID NO: 42 - DNA, 360 bp, Mus musculus
  misc_feature (1)..(360): SC16.10 VH
  CDS (1)..(360)
caggttactctgaaagagtctggccctgggatattgcagtcctcccagaccctcagtctgacttgttctttctctgggttttcactgagcacttctggtatgggtgtaggctggattcgtcagccatcagggaagggtctggagtggctggcacacatttggtgggatgatgtcaagcgctataacccagtcctgaagagccgactgactatctccaaggatacctccagcagccaggtattcctcaagatcgccagtgtggacactgcagatactgccacatactattgtgctcgattagttgatgatctgtactactttgactactggggccaaggcaccactctcacagtctcctca

SEQ ID NO: 43 - protein, 120 aa, Mus musculus
QVTLKESGPGILQSSQTLSLTCSFSGFSLSTSGMGVGWIRQPSGKGLEWLAHIWWDDVKRYNPVLKSRLTISKDTSSSQVFLKIASVDTADTATYYCARLVDDLYYFDYWGQGTTLTVSS

SEQ ID NO: 44 - DNA, 336 bp, Mus musculus
  misc_feature (1)..(336): SC16.11 VL
  CDS (1)..(336)
gatgttgagatgacccagactccactcactttgtcggttaccattggacaaccagcctccatctcttgcaagtcaagtcagagcctctcagacagtgatggaaagacatatttgaattggatgtttcagaggccaggccggtctccaaagcgcctaatctatctggtgtctaaactggactctggagtccctgacaggttcactggcagtggatcagggacagatttcacactgaaaatcagcagagtggaggctgaggatttgggagtttactattgctggcaaggtaaacattttccgtggacgttcggtggaggcaccaagctggaaatcaaa

SEQ ID NO: 45 - protein, 112 aa, Mus musculus
DVEMTQTPLTLSVTIGQPASISCKSSQSLSDSDGKTYLNWMFQRPGRSPKRLIYLVSKLDSGVPDRFTGSGSGTDFTLKISRVEAEDLGVYYCWQGKHFPWTFGGGTKLEIK

SEQ ID NO: 46 - DNA, 351 bp, Mus musculus
  misc_feature (1)..(351): SC16.11 VH
  CDS (1)..(351)
cagatccagttggtgcagtctggacctgagctgaagaagcctggagagacagtcaagatctcctgcaaggcttctggttataccttcacagactattcaatgcactgggtgaagcaggctccaggaaagggtttaaagtggatgggctggataaacactgagactgttgagccaacatatgcagatgacttcatgggacggtttgccttctctttggaaacctctgccagcactgcctttttgcagatcaacaacctcgaaaatgaggacacggctacatatttctgtgctagatttggttcctatgctatggactactggggtcaaggaacctcagtcaccgtctcctca

SEQ ID NO: 47 - protein, 117 aa, Mus musculus
QIQLVQSGPELKKPGETVKISCKASGYTFTDYSMHWVKQAPGKGLKWMGWINTETVEPTYADDFMGRFAFSLETSASTAFLQINNLENEDTATYFCARFGSYAMDYWGQGTSVTVSS

SEQ ID NO: 48 - DNA, 318 bp, Mus musculus
  misc_feature (1)..(318): SC16.13 VL
  CDS (1)..(318)
caaattgttctcacccagtctccagcactcgtgtctgcatctccaggggagaaggtcaccatgacctgcagtgccagctcaagtgtaagttacatgtactggtaccagcagaaaccaagatcctcccccaaaccctggatttatctcacatccaacctggcttctggagtccctgctcgcttcagtggcagtgggtctgggacctcttactctctcacaatcagcagcatggaggctgaagatgctgccacttattactgccagcagtggcgtagtaacccattcacgttcggctcggggacaaagttggaaataaaa

SEQ ID NO: 49 - protein, 106 aa, Mus musculus
QIVLTQSPALVSASPGEKVTMTCSASSSVSYMYWYQQKPRSSPKPWIYLTSNLASGVPARFSGSGSGTSYSLTISSMEAEDAATYYCQQWRSNPFTFGSGTKLEIK

SEQ ID NO: 50 - DNA, 372 bp, Mus musculus
  misc_feature (1)..(372): SC16.13 VH
  misc_feature (372)..(372): The 'n' at position 372 may be a or g or c or t
  CDS (1)..(372)
caggttactctgaaagagtctggccctgggatattgcagccctcccagaccctcagtctgacttgttctttctctgggttttcactgagcacttctggtatgggtgtaggctggattcggcagccatcagggaagggtctggagtggctggcacacatttggtgggatgatgtcaagcgctataacccagccctgaagagccgactgactatctccaaggatacctccagcagccaggtattcctcaagatcgccagtgtggacactgcagatactgccacatactactgtgctcgcatagtttcctttgataacgacgttgtctctgctatggactactggggtcaaggaacctcagtcaccgtctcctcn

SEQ ID NO: 51 - protein, 124 aa, Mus musculus
  misc_feature (124)..(124): The 'Xaa' at location 124 stands for Ser.
QVTLKESGPGILQPSQTLSLTCSFSGFSLSTSGMGVGWIRQPSGKGLEWLAHIWWDDVKRYNPALKSRLTISKDTSSSQVFLKIASVDTADTATYYCARIVSFDNDVVSAMDYWGQGTSVTVSX

SEQ ID NO: 52 - DNA, 321 bp, Mus musculus
  misc_feature (1)..(321): SC16.15 VL
  CDS (1)..(321)
gacatccagatgactcagtctccagcctccctggctgcatctgtgggagaaactgtcgccatcacatgtcgagcaagtgagaacatttactacaatttagcatggtatcagcagaaacaagggaaatctcctcagctcctgatctatactgcaaacagtttggaagatggtgtcccatcgaggttcagtggcagtggatctgggacacagtattctttgaagatcaacagcatgcagcctgaagattccgcaacttatttctgtaaacaggcttatgacgttcctccgacgttcggtggaggcaccaagctggaaatcaaa

SEQ ID NO: 53 - protein, 107 aa, Mus musculus
DIQMTQSPASLAASVGETVAITCRASENIYYNLAWYQQKQGKSPQLLIYTANSLEDGVPSRFSGSGSGTQYSLKINSMQPEDSATYFCKQAYDVPPTFGGGTKLEIK

SEQ ID NO: 54 - DNA, 351 bp, Mus musculus
  misc_feature (1)..(351): SC16.15 VH
  CDS (1)..(351)
caggtccagcttcagcagtctggggctgaactggcaaaacctggggcctcagtgaagatgtcctgtaaggcttctggctacacctttactcgctactggatacactggataaaacagaggcctggacagggtctggaatggattggatacattaatcctacaactgtttatactgagttcaatcagaacttcaaggacaaggccactttgactgcagacaaatcctccaccacagcctccatgcaactgagcagcctgacatctgaggactctgcagtctattactgtgcaagaggcggtagtaacttctttgactactggggccaaggcaccactctcacagtctcctca

SEQ ID NO: 55 - protein, 117 aa, Mus musculus
QVQLQQSGAELAKPGASVKMSCKASGYTFTRYWIHWIKQRPGQGLEWIGYINPTTVYTEFNQNFKDKATLTADKSSTTASMQLSSLTSEDSAVYYCARGGSNFFDYWGQGTTLTVSS

SEQ ID NO: 56 - DNA, 321 bp, Mus musculus
  misc_feature (1)..(321): SC16.18 VL
  CDS (1)..(321)
gatatccagatgacacagactacatcctccctgtctgcctctttgggagacagagtcaccatcagttgcagggcaagtcagaatattatcaattatttaaactggtatcagcagaagccagatggaactgttaaactcctgatctactacacatcaagattacactcaggagtcccatcaaggttcagtggcagtgggtctgggacagattattctctcaccatcagcaacctggaacctgaagatattgccacttactattgtcaacagtatagtgagcgtccgtacacgttcgggggggggaccaagctggaaataaaa

SEQ ID NO: 57 - protein, 107 aa, Mus musculus
DIQMTQTTSSLSASLGDRVTISCRASQNIINYLNWYQQKPDGTVKLLIYYTSRLHSGVPSRFSGSGSGTDYSLTISNLEPEDIATYYCQQYSERPYTFGGGTKLEIK

SEQ ID NO: 58 - DNA, 351 bp, Mus musculus
  misc_feature (1)..(351): SC16.18 VH
  CDS (1)..(351)
gaagtgaagctggaggagtcaggaggaggcttggtacaacctggagaatccatgaaactctcttgtgctgcttctggattcacttttagtgatgcctggatggactgggtccgccagtctccagagaagggacttgagtgggttgctgaaattagaaacaaagctaataatcatgcaacatattatgctgagtctgtgaaagggaaattcaccatctcaagagatgattccaaaagtagagtgtacctgcaaatgaacaacttaagagctgcagacactggcatttattactgtacggcctatagtaactttgcttactggggccaagggactctggtcactgtctctaca

SEQ ID NO: 59 - protein, 117 aa, Mus musculus
EVKLEESGGGLVQPGESMKLSCAASGFTFSDAWMDWVRQSPEKGLEWVAEIRNKANNHATYYAESVKGKFTISRDDSKSRVYLQMNNLRAADTGIYYCTAYSNFAYWGQGTLVTVST

SEQ ID NO: 60 - DNA, 318 bp, Mus musculus
  misc_feature (1)..(318): SC16.19 VL
  CDS (1)..(318)
gacatccagatgacacagtctccatcctcactgtctgcatctctgggaggcaaagtcaccttcacttgcaaggcaagccaagacattcacaagtatgtagcttggtaccaacacaagcctggaaaaggtcctaggctgctcatacattacacatctacattacagccaggcatctcatcaaggttcagtggaagtgggtctgggagagattattccttcagcatcagcaacctggagcctgaagatattgcaacttattattgtctacagtataataatctgtacacgttcggaggggggaccaagctggaaataaaa

SEQ ID NO: 61 - protein, 106 aa, Mus musculus
DIQMTQSPSSLSASLGGKVTFTCKASQDIHKYVAWYQHKPGKGPRLLIHYTSTLQPGISSRFSGSGSGRDYSFSISNLEPEDIATYYCLQYNNLYTFGGGTKLEIK

SEQ ID NO: 62 - DNA, 354 bp, Mus musculus
  misc_feature (1)..(354): SC16.19 VH
  CDS (1)..(354)
gaggttcagctgcagcagtctggggctgagcttgtgaggccaggggcctcagtcaagttgtcctgcacagcttctggcttcaacattaaagacagccttttgcactgggtgaagcagaggcctgaaaagggcctggagtggattgggtggattgatcctgaggatggtgaaactaaatatgccccgaacttccaggacaaggccactataactacagactcatcctccaacacagcctacctgcaactcatcagcctgacatctgttgacactgccatctattactgtgcctatggtaactacgtgcggcactttgactactggggccaaggcaccactctcacagtctcctca

SEQ ID NO: 63 - protein, 118 aa, Mus musculus
EVQLQQSGAELVRPGASVKLSCTASGFNIKDSLLHWVKQRPEKGLEWIGWIDPEDGETKYAPNFQDKATITTDSSSNTAYLQLISLTSVDTAIYYCAYGNYVRHFDYWGQGTTLTVSS

SEQ ID NO: 64 - DNA, 321 bp, Mus musculus
  misc_feature (1)..(321): SC16.20 VL
  CDS (1)..(321)
gaaatccagatgacccagtctccatcctctatgtctgcatctctgggagacagaataaccatcacttgccaggcaactcaagacattgttaagaatttaaactggtatcagcagaaaccagggaaacccccttcattcctgatctattatgcaactgaactggcagaaggggtcccatcaaggttcagtggcagtgggtctgggtcagactattctctgacaatcaggaacctggagtctgaagactttgcagaccattactgtctacagttttatgagtttccgttcacgttcggtgctgggaccaagctggagctgaaa

SEQ ID NO: 65 - protein, 107 aa, Mus musculus
EIQMTQSPSSMSASLGDRITITCQATQDIVKNLNWYQQKPGKPPSFLIYYATELAEGVPSRFSGSGSGSDYSLTIRNLESEDFADHYCLQFYEFPFTFGAGTKLELK

SEQ ID NO: 66 - DNA, 363 bp, Mus musculus
  misc_feature (1)..(363): SC16.20 VH
  CDS (1)..(363)
caggtccagttgcagcagtctggaactgagctggtaaggcctgggacttcagtgagggtgtcctgcaaggcttctggatacgccttcggtaatcacttgattgagtgggtgaagcagaggcctggacagggccttgagtggattggagtgattaatcctggaactggtggtactcactacaatgagaagttcaaggacaaggcaagactgaccgcagacaaatcctccaacactgcctacatgcacctcaacagcctgacatctgatgactctgcggtctatttctgtgcaagatccccctatgattaccacgagggtgctatggactactggggtcaaggaacctcagtcaccgtctcctca

SEQ ID NO: 67 - protein, 121 aa, Mus musculus
QVQLQQSGTELVRPGTSVRVSCKASGYAFGNHLIEWVKQRPGQGLEWIGVINPGTGGTHYNEKFKDKARLTADKSSNTAYMHLNSLTSDDSAVYFCARSPYDYHEGAMDYWGQGTSVTVSS

SEQ ID NO: 68 - DNA, 339 bp, Mus musculus
  misc_feature (1)..(339): SC16.21 VL
  CDS (1)..(339)
gacattgtgatgacacagtctccatcctccctggctatgtcagtaggacagaaggtcactatgagctgcaagtccagtcagagccttttaaatagtagcaatcaaaagaattatttggcctggtatcagcaggaaccaggacagtctcctaaacttctggtatcctttgcatccactagggaatctggggtccctgatcgcttcacaggcagtggatctgggacagatttcactcttaccatcagcggtgtgcaggctgaagacctggcagtttattactgtcagcaacattatagcattccgctcacgttcggtgctgggaccaagctggagctgaaa

SEQ ID NO: 69 - protein, 113 aa, Mus musculus
DIVMTQSPSSLAMSVGQKVTMSCKSSQSLLNSSNQKNYLAWYQQEPGQSPKLLVSFASTRESGVPDRFTGSGSGTDFTLTISGVQAEDLAVYYCQQHYSIPLTFGAGTKLELK

SEQ ID NO: 70 - DNA, 372 bp, Mus musculus
  misc_feature (1)..(372): SC16.21 VH
  CDS (1)..(372)
caggttcagctacaacagtctggacctgagctggtgaagcctggggcctcagtgaagatttcctgcaaggcttctggctatgcattcagtagctcctggatgaactgggtgaagcagaggcctggaaagggtcttgagtggattggacggatttatcctggagatggagatactaactacaatgggaagttcaagggcaaggccacactgactgcagacaaatcctccagcacagcctacatgcaactcagcagcctgacatctgaggactctgcggtctacttctgtgcaatgggtatttataactacgatggtagccgttactattctatggactactggggtcaaggaacctcagtcaccgtctcctca

SEQ ID NO: 71 - protein, 124 aa, Mus musculus
QVQLQQSGPELVKPGASVKISCKASGYAFSSSWMNWVKQRPGKGLEWIGRIYPGDGDTNYNGKFKGKATLTADKSSSTAYMQLSSLTSEDSAVYFCAMGIYNYDGSRYYSMDYWGQGTSVTVSS

SEQ ID NO: 72 - DNA, 321 bp, Mus musculus
  misc_feature (1)..(321): SC16.22 VL
  CDS (1)..(321)
gatatccagatgacacagactacatcctccctgtctgcctctctgggagacagagtcaccatcagttgcagggcaagtcaggacattaagaattatttaaactggtatcagcagaaaccagatggaactgttaaacccctgatctactacacatcaagagtacactcaggagtcccatcaaggttcagtggcagtgggtctggaacagattattctctcaccattagcaacctggagcaagaagatattgccacttacttttgccagcagggttatacgcttccattcacgttcggctcggggacaaagttggaaathaar

SEQ ID NO: 73 - protein, 107 aa, Mus musculus
DIQMTQTTSSLSASLGDRVTISCRASQDIKNYLNWYQQKPDGTVKPLIYYTSRVHSGVPSRFSGSGSGTDYSLTISNLEQEDIATYFCQQGYTLPFTFGSGTKLEIK

SEQ ID NO: 74 - DNA, 360 bp, Mus musculus
  misc_feature (1)..(360): SC16.22 VH
  CDS (1)..(360)
caggtccagctgcagcagcctggggctgaactggtgaagcctggggcttcagtgaagctgtcctgtaaggcttctggatacaccttcactacctactggatgcactgggtgaagcagaggcctggacaaggccttgagtggatcggagagattgatccttctgatagttatacttactacaatcaaaagttcaagggcaaggccacattgactgtagacaaatcctccagcacagcctacatgcaactcagcagcctgacatctgaggactctgcggtctattattgtgcaagaggggactatggtaacccctatgctatggactactggggtcaaggatcctcagtcaccgtctcctca

SEQ ID NO: 75 - protein, 120 aa, Mus musculus
QVQLQQPGAELVKPGASVKLSCKASGYTFTTYWMHWVKQRPGQGLEWIGEIDPSDSYTYYNQKFKGKATLTVDKSSSTAYMQLSSLTSEDSAVYYCARGDYGNPYAMDYWGQGSSVTVSS

SEQ ID NO: 76 - DNA, 324 bp, Mus musculus
  misc_feature (1)..(324): SC16.23 VL
  CDS (1)..(324)
caaattgttctcacccagtctccagcaatcatgtctgcatctcctggggagaaggtcaccttgacctgcagtgccagctcaagtgtaagttccaggtacttgtactggtaccagcagaagccaggatcctcccccaaactctggatttatagcacatccaacctggcttctggagtccctgctcgcttcagtggcagtgggtctgggacctcttactctctcataatcagcagcatggaggctgaagatgctgcctcttatttctgccatcagtggagtaattacccactcacgttcggtgctgggaccaagctggagctgaaa

SEQ ID NO: 77 - protein, 108 aa, Mus musculus
QIVLTQSPAIMSASPGEKVTLTCSASSSVSSRYLYWYQQKPGSSPKLWIYSTSNLASGVPARFSGSGSGTSYSLIISSMEAEDAASYFCHQWSNYPLTFGAGTKLELK

SEQ ID NO: 78 - DNA, 372 bp, Mus musculus
  misc_feature (1)..(372): SC16.23 VH
  CDS (1)..(372)
caggttactctgaaagagtctggccctgggatattgcagccctcccagaccctcagtctgacttgttctttctctgggttttcactgagcacttctaatacgggcataggctggattcgtcagccttcagggacgggtctggagtggctggcacacatttggtggaatgatgataagtactataatccatccctgaagagccggctcacaatctccaaggaaacctccaacaaccaggtattcctcaagatcaccaatgtggacactgcagatactgcctcatacttctgtgttcaaatcgggcgcgactacagtaactacgcctggtatttcgatgtctggggcgcagggaccacggtcaccgtctcctca

SEQ ID NO: 79 - protein, 124 aa, Mus musculus
QVTLKESGPGILQPSQTLSLTCSFSGFSLSTSNTGIGWIRQPSGTGLEWLAHIWWNDDKYYNPSLKSRLTISKETSNNQVFLKITNVDTADTASYFCVQIGRDYSNYAWYFDVWGAGTTVTVSS

SEQ ID NO: 80 - DNA, 318 bp, Mus musculus
  misc_feature (1)..(318): SC16.25 VL
  CDS (1)..(318)
caaattgttctcacccagtctccagcaatcatgtctgcatctccaggggagaaggtcaccatgacctgcagtgccagctcaagtgtaagttacatgcactggtaccagcagaagtcaggcacctcccccaaaagatggatttatgactcatccaaactggcttctggagtccctgctcgcttcagtggcagtgggtctgggacctcttactctctcacaatcagcagcatggaggctgaagatgctgccacttattactgccagcagtggagtagtaacccgctcacgttcggtgctgggaccaagctggagctgaaa

SEQ ID NO: 81 - protein, 106 aa, Mus musculus
QIVLTQSPAIMSASPGEKVTMTCSASSSVSYMHWYQQKSGTSPKRWIYDSSKLASGVPARFSGSGSGTSYSLTISSMEAEDAATYYCQQWSSNPLTFGAGTKLELK

SEQ ID NO: 82 - DNA, 372 bp, Mus musculus
  misc_feature (1)..(372): SC16.25 VH
  CDS (1)..(372)
caggttactctgaaagagtctggccctgggatattgcagccctcccagaccctcagtctgacttgttctttctctgggttttcactgagcacttctggtatgggtgtaggctggattcgtcagccttcaggagagggtctagagtggctgacagacatttggtgggatgacaataagtactataacccatccctgaagagccggctcacaatctccaaggatacctccagcaaccaggtattcctcaatatcaccagtgtggacactgcagatactgccacttactactgtgctcgaagagttaactattattacgacccgtactatgctatggactactggggtcaaggaacctcagtcaccgtctcctca

SEQ ID NO: 83 - protein, 124 aa, Mus musculus
QVTLKESGPGILQPSQTLSLTCSFSGFSLSTSGMGVGWIRQPSGEGLEWLTDIWWDDNKYYNPSLKSRLTISKDTSSNQVFLNITSVDTADTATYYCARRVNYYYDPYYAMDYWGQGTSVTVSS

SEQ ID NO: 84 - DNA, 336 bp, Mus musculus; identical to SEQ ID NO: 44
  misc_feature (1)..(336): SC16.26 VL
  CDS (1)..(336)

SEQ ID NO: 85 - protein, 112 aa, Mus musculus; identical to SEQ ID NO: 45

SEQ ID NO: 86 - DNA, 351 bp, Mus musculus
  misc_feature (1)..(351): SC16.26 VH
  misc_feature (339)..(339): The 'n' at position 339 may be a or g or c or t
  misc_feature (342)..(342): the 'v' at position 342 may be a or g or c
  misc_feature (345)..(345): The 'n' at position 345 may be a or g or c or t
  misc_feature (348)..(348): The 'n' at position 348 may be a or g or c or t
  misc_feature (351)..(351): The 'n' at position 351 may be a or g or c or t
  CDS (1)..(351)
cagatccagttggtgcagtctggacctgagctgaagaagcctggagagacagtcaagatctcctgcaaggcttctggttattccttcacagactattcaatgcactgggtgaagcaggctccaggaaagggtttaaagtggatgggctggataaacactgagactgttgagccaacatatgcagatgacttcatgggacggtttgccttctctttggaaacctctgccagcactgcctttttgcagatcaacaacctcgaaaatgaggacacggctacatatttctgtgctagatttggttcctatgctatggactactggggtcaaggaacctcagtnacvgtntcntcn

SEQ ID NO: 87 - protein, 117 aa, Mus musculus
  misc_feature (114)..(114): The 'Xaa' at location 114 stands for Thr.
  misc_feature (116)..(116): The 'Xaa' at location 116 stands for Ser.
  misc_feature (117)..(117): The 'Xaa' at location 117 stands for Ser.
QIQLVQSGPELKKPGETVKISCKASGYSFTDYSMHWVKQAPGKGLKWMGWINTETVEPTYADDFMGRFAFSLETSASTAFLQINNLENEDTATYFCARFGSYAMDYWGQGTSVXVXX

SEQ ID NO: 88 - DNA, 318 bp, Mus musculus
  misc_feature (1)..(318): SC16.29 VL
  CDS (1)..(318)
caaattgttctcacccagtctccagcaatcatgtctgcatctccaggggagaaggtcaccataacctgcagtgccagctcaagtgtaagttacatgcactggttccagcagaagccaggcacttctcccaaactctggatttataccacatccaacctggcttctggagtccctgctcgcttcagtggcagtggatctgggacctcttactctctcacagtcagccgaatggaggctgaagatgctgccacttattactgccagcaaaggagtctttatccgtacacgttcggaggggggaccaaggtggaaataaaa

SEQ ID NO: 89 - protein, 106 aa, Mus musculus
QIVLTQSPAIMSASPGEKVTITCSASSSVSYMHWFQQKPGTSPKLWIYTTSNLASGVPARFSGSGSGTSYSLTVSRMEAEDAATYYCQQRSLYPYTFGGGTKVEIK

SEQ ID NO: 90 - DNA, 363 bp, Mus musculus
  misc_feature (1)..(363): SC16.29 VH
  CDS (1)..(363)
caggttcagctacagcagtctggagctgagctggcgaggcccggggcttcagtgaagctgtcctgcaaggcttcaggctacaccttcactgaccagtatataaactgggtgaagcagaggactggacagggccttgagtggattggagagatttatcccggaaggggtaatacttactacaatgagaagttcaagggcaaggccacactgactgcagacaaatcctccagcacagcctacatgcaactcagcagcctgacatctgaggactctgcagtctatttctgtgcaagagaggatggtggttacgacgatgcctggtttgcttactggggccaagggactctggtcactgtctctgca

SEQ ID NO: 91 - protein, 121 aa, Mus musculus
QVQLQQSGAELARPGASVKLSCKASGYTFTDQYINWVKQRTGQGLEWIGEIYPGRGNTYYNEKFKGKATLTADKSSSTAYMQLSSLTSEDSAVYFCAREDGGYDDAWFAYWGQGTLVTVSA

SEQ ID NO: 92 - DNA, 324 bp, Mus musculus
  misc_feature (1)..(324): SC16.30 VL
  CDS (1)..(324)
caaattgttctgacccagtctccaacaatcatgtctgcatctctaggggaacgggtcaccatgacctgcactgccagctcaagtgtaacttccagttacttgcactggtaccagcagaagccaggatcctcccccaaactctggatttatagcacatccaacctggcttctggagtcccagctcgcttcagtggcagtgggtctgggacctcttactctctcacaatcagcagcatggaggctgaagatgctgccacttattactgccaccagtttcatcgttccccattcacgttcggctcggggacaaagttggaaataaaa

SEQ ID NO: 93 - protein, 108 aa, Mus musculus
QIVLTQSPTIMSASLGERVTMTCTASSSVTSSYLHWYQQKPGSSPKLWIYSTSNLASGVPARFSGSGSGTSYSLTISSMEAEDAATYYCHQFHRSPFTFGSGTKLEIK

SEQ ID NO: 94 - DNA, 360 bp, Mus musculus
  misc_feature (1)..(360): SC16.30 VH
  CDS (1)..(360)
caggttactctgaaagagtctggccctgggatattgcagccctcccagaccctcagtctgacttgttctttctctgggttttcactgagcacttctggtatgggtgtaggctggattcgtcagccatcagggaagggtctggagtggctggcacacatttggtgggatgatgtcaagcgctataaaccagccctgaagagccgactgactgtctccaaggatacctccagcaaccaggttttcctcaagatcgccactgtggacgctgcagatactggcacatactactgtgctcgaatcgttgatggtcaccccccgtttgcttactggggccaagggactctggtcactgtctctgca

SEQ ID NO: 95 - protein, 120 aa, Mus musculus
QVTLKESGPGILQPSQTLSLTCSFSGFSLSTSGMGVGWIRQPSGKGLEWLAHIWWDDVKRYKPALKSRLTVSKDTSSNQVFLKIATVDAADTGTYYCARIVDGHPPFAYWGQGTLVTVSA

SEQ ID NO: 96 - DNA, 336 bp, Mus musculus
  misc_feature (1)..(336): SC16.30 VL
  CDS (1)..(336)
gacattgtgctgacccagtctccactctctctgcctgtcaatattggagatcaagcctctatctcttgcaagtctactaagagtcttctgaatagtgatggattcacttatttggactggtatttgcagaggccaggccagtctccacaattcctaatatatttggtttctaatcgattttctggagttccagacaggttcagtggcagtgggtcaggaacagatttcacactcaagatcagcagagtggaggctgaggatttgggagtatattattgcttccagagtaactatcttccgctcacgttcggtgctgggaccaagctggagctgaga

SEQ ID NO: 97 - protein, 112 aa, Mus musculus
DIVLTQSPLSLPVNIGDQASISCKSTKSLLNSDGFTYLDWYLQRPGQSPQFLIYLVSNRFSGVPDRFSGSGSGTDFTLKISRVEAEDLGVYYCFQSNYLPLTFGAGTKLELR

SEQ ID NO: 98 - DNA, 357 bp, Mus musculus
  misc_feature (1)..(357): SC16.31 VH
  CDS (1)..(357)
gaggtccaactgcagcagtctggacctgagctggtgaagcctggggcttcagtgaagatatcctgcaaggcttctggttactcattcagtcgtttctatatgcactgggtgaagcaaagtcctgaaaatagtcttgagtggattggagagattaatcctagcactgggggtacaagctacaaccagaagttcaagggcaaggccacattaactgtagataaatcctccagcacagcctacatgcagctcaagagcctgacatctgaagagtctgcagtctattactgtactaggggttacgggagcaactggtacttcgatgtctggggcgcagggaccacggtcaccgtctccaca

SEQ ID NO: 99 - protein, 119 aa, Mus musculus
EVQLQQSGPELVKPGASVKISCKASGYSFSRFYMHWVKQSPENSLEWIGEINPSTGGTSYNQKFKGKATLTVDKSSSTAYMQLKSLTSEESAVYYCTRGYGSNWYFDVWGAGTTVTVST

SEQ ID NO: 100 - DNA, 321 bp, Mus musculus
  misc_feature (1)..(321): SC16.34 VL
  CDS (1)..(321)
agtattgtgatgacccagactcccaaattcctgcttgtatcagcaggagacagggttaccataacctgcaaggccagtcagagtgtgagtaatgatgtagcttggtaccaacagaagccagggcagtctcctaaactgctgatatactatgcatccaatcgctacagtggagtccctgatcgcttcactggcagtggatatgggacggatttcactttcaccatcagcactgtgcaggctgaagacctggcagtttatttctgtcagcaggattatagctctccgtggacgttcggtggaggcaccaagctggaaatcaaa

SEQ ID NO: 101 - protein, 107 aa, Mus musculus
SIVMTQTPKFLLVSAGDRVTITCKASQSVSNDVAWYQQKPGQSPKLLIYYASNRYSGVPDRFTGSGYGTDFTFTISTVQAEDLAVYFCQQDYSSPWTFGGGTKLEIK

SEQ ID NO: 102 - DNA, 354 bp, Mus musculus
  misc_feature (1)..(354): SC16.34 VH
  CDS (1)..(354)
cagatccagttggtgcagtctggacctgagctgaagaggcctggagagacagtcaagatctcctgcaaggcttctggatataccttcacaaactatggaatgaactgggtgaagcaggctccaggaaagggtttaaagtggatgggctggataaacacgtacactggagacccaacatatgctgatgacttcaagggacggtttgccttctctttggaaacctctgccagcactgcctatttgcagatcaacaacctcaaaaatgaggacacggctacatatttctgtgcaagaattggcggtaatagtccctctgattactggggccaaggcacctctctcacagtctcctca

SEQ ID NO: 103 - protein, 118 aa, Mus musculus
QIQLVQSGPELKRPGETVKISCKASGYTFTNYGMNWVKQAPGKGLKWMGWINTYTGDPTYADDFKGRFAFSLETSASTAYLQINNLKNEDTATYFCARIGGNSPSDYWGQGTSLTVSS

SEQ ID NO: 104 - DNA, 321 bp, Mus musculus
  misc_feature (1)..(321): SC16.35 VL
  CDS (1)..(321)
gatatccagatgacacagactacatcctccctgtctgcctctctgggagacagagtcaccatcagttgcagggcaagtcaggacattagcaattatttaaactggtatcagcagaaaccagatggaactgttaaactcctgatctactacacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggaaataaaa

SEQ ID NO: 105 - protein, 107 aa, Mus musculus
DIQMTQTTSSLSASLGDRVTISCRASQDISNYLNWYQQKPDGTVKLLIYYTSRLHSGVPSRFSGSGSGTDYSLTISNLEQEDIATYFCQQGNTLPYTFGGGTKLEIK

SEQ ID NO: 106 - DNA, 360 bp, Mus musculus
  misc_feature (1)..(360): SC16.35 VH
  CDS (1)..(360)
gatgtgcagcttcaggagtcgggacctggcctggtgaaaccttctcagtctctgtccctcacctgcactgtcactggctactcaatcaccagtgattatgcctggaactggatccggcagtttccaggaaacaaactggagtggatgggctacataagctacagtggtagcactagctacaacccatctctcaaaagtcgaatctctatcactcgagacacatccaagaaccagttcttcctgcagttgaattctgtgactactgaggacacagccacatattactgtgcaagattttactacggtagtagctatgctatggactactggggtcaaggaacctcagtcaccgtctcctca

SEQ ID NO: 107 - protein, 120 aa, Mus musculus
DVQLQESGPGLVKPSQSLSLTCTVTGYSITSDYAWNWIRQFPGNKLEWMGYISYSGSTSYNPSLKSRISITRDTSKNQFFLQLNSVTTEDTATYYCARFYYGSSYAMDYWGQGTSVTVSS

SEQ ID NO: 108 - DNA, 321 bp, Mus musculus
  misc_feature (1)..(321): SC16.36 VL
  CDS (1)..(321)
gaaacaactgtgacccagtctccagcatccctgtccgtgactacaggagaaaaagtcactatcagatgcataaccacccctgatattgatgatgatatgaactggtaccagcagaagccaggggaacctcctaacctccttatttcagaaggcaatagtcttcgtcctggagtcccatcccgattctccagcagtggctatggcacaaattttgtttttacaattgaaaacacgctctcagaagatgttgcagattactactgtttgcaaagtgataacatgccattcacgttcggctcggggacaaagttggaaataaar

SEQ ID NO: 109 - protein, 107 aa, Mus musculus
ETTVTQSPASLSVTTGEKVTIRCITTPDIDDDMNWYQQKPGEPPNLLISEGNSLRPGVPSRFSSSGYGTNFVFTIENTLSEDVADYYCLQSDNMPFTFGSGTKLEIK

SEQ ID NO: 110 - DNA, 354 bp, Mus musculus
  misc_feature (1)..(354): SC16.35 VH
  misc_feature (354)..(354): The 'n' at position 354 may be a or g or c or t
  CDS (1)..(354)
caggtccagctgcagcagtctggggctgaactggcaaaacctggggcctcagtgaagatgtcctgcaaggcttctggctacacctttactacctactggatgcactgggtaaaacagaggcctggacagggtctggaatggattggatacattaatcctagcagtggttatactgagtacaatcagaagttcaaggacaaggccacattgactgcagacaaatcctccagcacagcctacatgcaactaagcagcctgacatctgaggactcttcagtctattactgtgcaagaaagggtagtaacagggggtttgcttactggggccaagggactctggtcactgtctcttcn

SEQ ID NO: 111 - protein, 118 aa, Mus musculus
  misc_feature (118)..(118): The 'Xaa' at location 118 stands for Ser.
QVQLQQSGAELAKPGASVKMSCKASGYTFTTYWMHWVKQRPGQGLEWIGYINPSSGYTEYNQKFKDKATLTADKSSSTAYMQLSSLTSEDSSVYYCARKGSNRGFAYWGQGTLVTVSX

SEQ ID NO: 112 - DNA, 312 bp, Mus musculus
  misc_feature (1)..(312): SC16.38 VL
  CDS (1)..(312)
caaattgttctcacccagtctccagcaatcatgtctgcatctccaggggagaaggtcaccatgacctgcagtgccagctcaagtataaattacatgcactggtaccagcagaagccaggcacctcccccaaaagatggatttatgacacatccaaactggcttctggagtccctgctcgcttcagtggcagtgggtctgggacctcttattctctcacaatcagcagcatggaggctgaagatgctgccacttattactgccatcagcggagtacgtggacgttcggtggaggcaccaagctggaaatcaaa

SEQ ID NO: 113 - protein, 104 aa, Mus musculus
QIVLTQSPAIMSASPGEKVTMTCSASSSINYMHWYQQKPGTSPKRWIYDTSKLASGVPARFSGSGSGTSYSLTISSMEAEDAATYYCHQRSTWTFGGGTKLEIK

SEQ ID NO: 114 - DNA, 348 bp, Mus musculus
  misc_feature (1)..(348): SC16.38 VH
  CDS (1)..(348)
gaggttcagctgcagcagtctggggcagagcttgtgaagccaggggcctcagtcaagttgtcctgcacagtttctggcttcaacattaaagacacctatatacactgggtgaagcagaggcctgaacagggcctggagtggattggaaggattgatcctgcgaatggtaatactaaatatgacccgaagttccagggcaaggccactataacagcagacacatcctccaacacagcctacctgcagctcagcagcctgacatctgaggacactgccgtctattactgtgctagaccgacggggtactttgaatactggggccaaggcaccactctcacagtctcctca

SEQ ID NO: 115 - protein, 116 aa, Mus musculus
EVQLQQSGAELVKPGASVKLSCTVSGFNIKDTYIHWVKQRPEQGLEWIGRIDPANGNTKYDPKFQGKATITADTSSNTAYLQLSSLTSEDTAVYYCARPTGYFEYWGQGTTLTVSS

SEQ ID NO: 116 - DNA, 321 bp, Mus musculus
  misc_feature (1)..(321): SC16.41 VL
  CDS (1)..(321)
gatatccagatgacacagactacatcctccctgtctgcctctttgggagacagagtcaccatcagttgcagggcaagtcaggatgttatcaattatttaaactggtatcagcagaaaccagatggaactgttaaactcctgatctactacacatcaaggttacactcaggagtcccatcaaggttcagtggcagtgggtctaggacagattattctctcaccatcagcaacctggaacctgaagatattgccacttactattgtcagcagtatagtgagcgtccgtacacgttcggaggggggaccaagctggaaataaaa

SEQ ID NO: 117 - protein, 107 aa, Mus musculus
DIQMTQTTSSLSASLGDRVTISCRASQDVINYLNWYQQKPDGTVKLLIYYTSRLHSGVPSRFSGSGSRTDYSLTISNLEPEDIATYYCQQYSERPYTFGGGTKLEIK

SEQ ID NO: 118 - DNA, 351 bp, Mus musculus
  misc_feature (1)..(351): SC16.41 VH
  CDS (1)..(351)
gaagtgaagcttgaggagtctggaggaggcttggtgcaatttggaggatccatgaaactctcttgtgctgcttctggattcacttttagtgatgcctggatggactgggtccgccagtctccagagaaggggcttgagtgggttgctgaaattagaaacaaagctaataatcatgcaacatattatcctgagtctgtgaaagggaggttcaccatctcaagagatgattccaaaagtagagtgtacctgcaaatgaacaacttaagagctgaagacactggcatttattactgtacgggttactcctcgtttgcttactggggccaagggactctggtcactgtctctgca

SEQ ID NO: 119 - protein, 117 aa, Mus musculus
EVKLEESGGGLVQFGGSMKLSCAASGFTFSDAWMDWVRQSPEKGLEWVAEIRNKANNHATYYPESVKGRFTISRDDSKSRVYLQMNNLRAEDTGIYYCTGYSSFAYWGQGTLVTVSA

SEQ ID NO: 120 - DNA, 336 bp, Mus musculus
  misc_feature (1)..(336): SC16.42 VL
  CDS (1)..(336)
gatgttttgatgacacagtctccactctccctgtctgtcagtcttggagatcaagcctccatctcttgtagatctagtcagaacattgtacacagtgatagatacacctatttagaatggtacctgcagaaaccaggccagtcgccaaaactcctgatatatggggtttccaaccgattttctggggtcccagacaggttcagtggcagtggatcagggacagatttcacactcaagatcagcagagtggaggctgaggatatgggagtttattactgctttcaaggtacacatgttccgtacacgttcggaggggggaccaagctggaaataaaa

SEQ ID NO: 121 - protein, 112 aa, Mus musculus
DVLMTQSPLSLSVSLGDQASISCRSSQNIVHSDRYTYLEWYLQKPGQSPKLLIYGVSNRFSGVPDRFSGSGSGTDFTLKISRVEAEDMGVYYCFQGTHVPYTFGGGTKLEIK

SEQ ID NO: 122 - DNA, 354 bp, Mus musculus
  misc_feature (1)..(354): SC16.42 VH
  CDS (1)..(354)
cagatccagttggtgcagtctggacctgaactgaagaagcctggagagacagtcaagatctcctgcaaggcttctgggtataccttcacaactgctggaatgcagtgggtgcaaaagatgccaggaaagggttttaagtggattggctggataaacacccactctggagagccaaaatatgcagatgacttcaagggacggtttgccttctctttggaaacctctgccagcactgcctatttacagataagcaacctcaaagacgaggacacggctacgtttttctgtgcgcccctatggtccgatagtagttttgcttactggggccaaggaactctggtcactgtctctgca

SEQ ID NO: 123 - protein, 118 aa, Mus musculus
QIQLVQSGPELKKPGETVKISCKASGYTFTTAGMQWVQKMPGKGFKWIGWINTHSGEPKYADDFKGRFAFSLETSASTAYLQISNLKDEDTATFFCAPLWSDSSFAYWGQGTLVTVSA

SEQ ID NO: 124 - DNA, 321 bp, Mus musculus
  misc_feature (1)..(321): SC16.45 VL
  CDS (1)..(321)
gaaatccagatgacccagtctccatcctctatgtctgcatctctgggagacagaataaccatcacttgccaggcaactcaagacattgttaagaatttaaactggtatcagcagaaaccagggaaacccccttcattcctgatctattatgcaactgaactggcagaaggggtcccagcaaggttcagtggcagtgggtctgggtcagactattctctgacaatcagcaacctggagtctgaagattttgcagactatcactgtctacagttttatgagtttccgttcacgttcggtgctgggaccaagctggagctgaaa

SEQ ID NO: 125 - protein, 107 aa, Mus musculus
EIQMTQSPSSMSASLGDRITITCQATQDIVKNLNWYQQKPGKPPSFLIYYATELAEGVPARFSGSGSGSDYSLTISNLESEDFADYHCLQFYEFPFTFGAGTKLELK

SEQ ID NO: 126 - DNA, 363 bp, Mus musculus
  misc_feature (1)..(363): SC16.45 VH
  CDS (1)..(363)
caggtccagctgcagcagtctggagctgacctggtaaggcctgggacttcagtgaaggtgtcctgcaaggcttctggatactccttcactaattacctgatagagtgggtaaagcagaggccaggacagggccttgagtggattggagtgattaatcctggaagtggtggaactcactacaatgagaaattcaaggacaaggcagttctgactgcagacaaatcctccactactgcccacatgcagctcagcagcctgacatctgatgactctgcggtctatttctgtgcaagatccccctatgattataacgatggtgctatggactactggggtcaaggaacctcagtcaccgtctcttca

SEQ ID NO: 127 - protein, 121 aa, Mus musculus
QVQLQQSGADLVRPGTSVKVSCKASGYSFTNYLIEWVKQRPGQGLEWIGVINPGSGGTHYNEKFKDKAVLTADKSSTTAHMQLSSLTSDDSAVYFCARSPYDYNDGAMDYWGQGTSVTVSS

SEQ ID NO: 128 - DNA, 336 bp, Mus musculus
  misc_feature (1)..(336): SC16.47 VL
  CDS (1)..(336)
gatgttgttctgacccagtctccactctctctgcctgtcaatattggagatcaagcctctatctcttgcaagtctactaagagtcttctgaatagtgatggattcacttatttggactggtatttgcagaggccaggccagtctccacaattcctaatatatttggtttctaatcgattttctggagttccagacaggttcagtggcagtgggtcaggaacagatttcacactcaagatcagcagagtggaggctgaggatttgggagtatattattgcttccagagtaactatcttccgctcacgttcggtgctgggaccaagctggagctgaga

SEQ ID NO: 129 - protein, 112 aa, Mus musculus
DVVLTQSPLSLPVNIGDQASISCKSTKSLLNSDGFTYLDWYLQRPGQSPQFLIYLVSNRFSGVPDRFSGSGSGTDFTLKISRVEAEDLGVYYCFQSNYLPLTFGAGTKLELR

SEQ ID NO: 130 - DNA, 357 bp, Mus musculus
  misc_feature (1)..(357): SC16.47 VH
  CDS (1)..(357)
gaggtccaactgcagcagtctggacctgagctggtgaagcctggggcttcagtgaagatatcctgcaaggcttctggttactcattcagtcgtttctatatgcactgggtgaagcaaagtcctgaaaatagtcttgagtggattggagagattaatcctagcactgggggtacaagctacaaccagaagttcaagggcaaggccacattaactgtagataaatcctccagcacagcctacatgcagctcaagagcctgacatctgaagagtctgcagtctattactgtactaggggttacgggagcaactgttacttcgatgtctggggcgcagggaccacggtcaccgtctccaca

SEQ ID NO: 131 - protein, 119 aa, Mus musculus
EVQLQQSGPELVKPGASVKISCKASGYSFSRFYMHWVKQSPENSLEWIGEINPSTGGTSYNQKFKGKATLTVDKSSSTAYMQLKSLTSEESAVYYCTRGYGSNCYFDVWGAGTTVTVST

SEQ ID NO: 132 - DNA, 321 bp, Mus musculus
  misc_feature (1)..(321): SC16.49 VL
  CDS (1)..(321)
gacatcaagatgacccagtctccatcttccatgtatgcatctctaggagagagagtcactatcacttgcaaggcgagtcaggacattaatagttatttaagctggttccagcagaaaccagggaaatctcctaagaccctgatctatcgagcaaacagattggtagatggggtcccatcaaggttcagtggcagtggatctgggcaagattattctctcaccatcaccagcctggagtatgaagatatgggaatttattattgtctacagtatgatgaatttccgctcacgttcggtgctgggaccaagctggagctgaaa

SEQ ID NO: 133 - protein, 107 aa, Mus musculus
DIKMTQSPSSMYASLGERVTITCKASQDINSYLSWFQQKPGKSPKTLIYRANRLVDGVPSRFSGSGSGQDYSLTITSLEYEDMGIYYCLQYDEFPLTFGAGTKLELK

SEQ ID NO: 134 - DNA, 351 bp, Mus musculus
  misc_feature (1)..(351): SC16.49 VH
  CDS (1)..(351)
caggttcaactgcagcagtctggacctgagctggtgaagcctgggactttagtgaagatatcctgcaaggcttctggttacaccttcacaagctacgatataaactgggtgaagcagaggcctggacagggacttgaatggattggatggatttatcctggagatggtaatactaagtacagtgagaaattcaagggcaaggccacactgactgcagacaaatcctccagcacagcctacatgcagctcaccagcctgacttctgagaactctgcagtctatttctgtgcaagagactatgattacccttttgcttactggggccaagggactctggtcactgtctctgca

SEQ ID NO: 135 - protein, 117 aa, Mus musculus
QVQLQQSGPELVKPGTLVKISCKASGYTFTSYDINWVKQRPGQGLEWIGWIYPGDGNTKYSEKFKGKATLTADKSSSTAYMQLTSLTSENSAVYFCARDYDYPFAYWGQGTLVTVSA

SEQ ID NO: 136 - DNA, 318 bp, Mus musculus
  misc_feature (1)..(318): SC16.50 VL
  CDS (1)..(318)
gatatccagatgacacagactacatcctccctgtctgcctctctgggagacagagtcaccatcagttgcagggcaagtcaggacattagcaattatttaaactggtatcagcagaaaccagatggaactgttaaactcctgatctactacacatcaagattacactcaggagtcccatcaaggttcagtggcagtgggtctggtacagattattctctcaccattagcaacctggagcaagaagatattgccacttacttttgccaacagggtaatacgcttcggacgttcggtggaggcaccaagctggaaatcaaa

SEQ ID NO: 137 - protein, 106 aa, Mus musculus
DIQMTQTTSSLSASLGDRVTISCRASQDISNYLNWYQQKPDGTVKLLIYYTSRLHSGVPSRFSGSGSGTDYSLTISNLEQEDIATYFCQQGNTLRTFGGGTKLEIK

SEQ ID NO: 138 - DNA, 363 bp, Mus musculus
  misc_feature (1)..(363): SC16.50 VH
  CDS (1)..(363)
gaagtgcagctggtggagtgtgggggatgcttagtgaagcctggagggtacctgaaactctcctgtgcagcctctggattcactttcagtagctatgccatgtcttgggttcgccagtctccagagaagaggctggagtgggtcgcagaaatcagtattggtggtagctacacctactatccagacactgtgacgggccgattcaccatctccagagacaatgccaagaacaccctgtacctggaaatgagcagtctgaggtctgaggacacggccatgtattactgtgcaagggagggctatgattacgacgtgagagctatggactactggggtcaaggaacctcagtcaccgtctcctca

SEQ ID NO: 139 - protein, 121 aa, Mus musculus
EVQLVECGGCLVKPGGYLKLSCAASGFTFSSYAMSWVRQSPEKRLEWVAEISIGGSYTYYPDTVTGRFTISRDNAKNTLYLEMSSLRSEDTAMYYCAREGYDYDVRAMDYWGQGTSVTVSS

SEQ ID NO: 140 - DNA, 321 bp, Mus musculus
  misc_feature (1)..(321): SC16.52 VL
  CDS (1)..(321)
gacatccagatgattcagtctccatcgtccatgtttgcctctctgggagacagagtcagtctctcttgtcgggctagtcagggcattagagggactttagactggtatcaacagaaaccaaatggaactattaaactcctgatctactccacatccaatttaaattctggtgtcccatcaaggttcagtggcagtgggtctgggtcagattattctctcaccatcagcagcctagagtctgaagattttgcagactattactgtctacagcgtaatgcgtatcctctcacgttcggtgctgggaccaagctggagctgaaa

SEQ ID NO: 141 - protein, 107 aa, Mus musculus
DIQMIQSPSSMFASLGDRVSLSCRASQGIRGTLDWYQQKPNGTIKLLIYSTSNLNSGVPSRFSGSGSGSDYSLTISSLESEDFADYYCLQRNAYPLTFGAGTKLELK

SEQ ID NO: 142 - DNA, 357 bp, Mus musculus
  misc_feature (1)..(357): SC16.52 VH
  CDS (1)..(357)
caggtgcagctgaaggagtcaggacctggcctggtggcgccctcacagagcctgtccatcacgtgcgctgtctctggattttcattaaccagctttgcaatacactggtttcgcaagcctccaggaaagggtctggagtggctgggagtaatatggactggtggaaccacaaattataattcggctctcatgtccagactgagcatcagcaaagacaactccaagagccaagttttcttaaaaatgaacagtctgcaaactgatgacacagccatgtactactgtgccagagacgattacgacaataattatgctatggactactggggtcaaggaacctcagtcaccgtctcctca

SEQ ID NO: 143 - protein, 119 aa, Mus musculus
QVQLKESGPGLVAPSQSLSITCAVSGFSLTSFAIHWFRKPPGKGLEWLGVIWTGGTTNYNSALMSRLSISKDNSKSQVFLKMNSLQTDDTAMYYCARDDYDNNYAMDYWGQGTSVTVSS

SEQ ID NO: 144 - DNA, 321 bp, Mus musculus
  misc_feature (1)..(321): SC16.55 VL
  CDS (1)..(321)
gacatcaagatgacccagtctccatcttccatgtatgcatctctaggagagagagtcactatcacttgcaaggcgagtcaggacattaatagctatttaaactggttccagcagaaaccagggaaatctcctaagaccctgatctatcgtgcaaacagattggtagatggggtcccatcaaggttcagtggcagtggatctgggcaagattattctctcaccatcagcagcctggagtatgaagatatgggaatttattattgtctacagtatgatgagtttccgtacacgttcggaggggggaccaagctggaaataaaa

SEQ ID NO: 145 - protein, 107 aa, Mus musculus
DIKMTQSPSSMYASLGERVTITCKASQDINSYLNWFQQKPGKSPKTLIYRANRLVDGVPSRFSGSGSGQDYSLTISSLEYEDMGIYYCLQYDEFPYTFGGGTKLEIK

SEQ ID NO: 146 - DNA, 351 bp, Mus musculus
  misc_feature (1)..(351): SC16.55 VH
  CDS (1)..(351)
gaggtgcagcttgttgagtctggtggaggattggtgcagcctaaagggtcattgaaactctcatgtgcagtctctgcattcaccttcactacctacgccatgaactgggtccgccaggctccaggaaagggtttggagtgggttgctcgcataagaaataaaagtaataattatgcaacatattatgccgattcagtgaaagacaggttcaccatctccagagatgattcacaaagcatgctctatctgcaaatgaacaacttgaaaattgaggacacagccatgtattactgtgtgttctactatgattacgtctactggggccaagggactctggtcactgtctctgca

SEQ ID NO: 147 - protein, 117 aa, Mus musculus
EVQLVESGGGLVQPKGSLKLSCAVSAFTFTTYAMNWVRQAPGKGLEWVARIRNKSNNYATYYADSVKDRFTISRDDSQSMLYLQMNNLKIEDTAMYYCVFYYDYVYWGQGTLVTVSA

SEQ ID NO: 148 - DNA, 321 bp, Mus musculus
  misc_feature (1)..(321): SC16.56 VL
  CDS (1)..(321)
agtattgtgatgacccagactcccaaattcctgcttgtatcagcaggagacagggttaccataacctgcaaggccagtcagagtgtgagtaatgatgtagtatggtaccaacagaagccagggcagtctcctaaactgctgatatactatgcatccaatcgctacactggagtccctgatcgcttcgctggcagtggatatgggacggatttctctttcaccatcagcactgtgcaggctgaagacctggcagtttatttctgtcagcaggattatacctctccgtggacgttcggtggaggcaccaagctggaaatcaga

SEQ ID NO: 149 - protein, 107 aa, Mus musculus
SIVMTQTPKFLLVSAGDRVTITCKASQSVSNDVVWYQQKPGQSPKLLIYYASNRYTGVPDRFAGSGYGTDFSFTISTVQAEDLAVYFCQQDYTSPWTFGGGTKLEIR

SEQ ID NO: 150 - DNA, 354 bp, Mus musculus
  misc_feature (1)..(354): SC16.56 VH
  CDS (1)..(354)
cagatccagttggtgcagtctggacctgaactgaagaagcctggagagacagtcaagatctcctgcaaggcttctgggtataccttcacaaactatggaatgaactgggtgaagcaggctccaggaaagggtttaaagtggatggcctggataaacacctacactggagagccaacatatgctgatgacttcaagggacggtttgccttctctttggaaacctctgccagcactgcctctttgcagatcatcaacctcaaaaatgaggacacggctacatatttctgtgcaaggatcggcgatagtagtccctctgactactgggggcagggcaccactctcacagtctcctca

SEQ ID NO: 151 - protein, 118 aa, Mus musculus
QIQLVQSGPELKKPGETVKISCKASGYTFTNYGMNWVKQAPGKGLKWMAWINTYTGEPTYADDFKGRFAFSLETSASTASLQIINLKNEDTATYFCARIGDSSPSDYWGQGTTLTVSS

SEQ ID NO: 152 - DNA, 321 bp, Mus musculus
  misc_feature (1)..(321): SC16.57 VL
  CDS (1)..(321)
gacattgtgatgacccagtctcacaaattcatgtccatatcagtaggagacagggtcagcatcacctgcaaggccagtcaggatgtgagtatttttgtagcctggtatcaacagaaaccaggacaatctcctaaactactgatttactcggcatcctaccggtacactggagtccctgatcgcttcactggcagtggatctgggacggatttcattttcaccatcagcagtgtgcaggctgaagacctggcagtttactactgtcagcaacattatggtactccattcacgttcggctcggggacaaagttgaaaataaga

SEQ ID NO: 153 - protein, 107 aa, Mus musculus
DIVMTQSHKFMSISVGDRVSITCKASQDVSIFVAWYQQKPGQSPKLLIYSASYRYTGVPDRFTGSGSGTDFIFTISSVQAEDLAVYYCQQHYGTPFTFGSGTKLKIR

SEQ ID NO: 154 - DNA, 354 bp, Mus musculus
  misc_feature (1)..(354): SC16.57 VH
  CDS (1)..(354)
gaagtgaaactggtggagtctgggggagacttagtgaagcctggagggtccctaaaactctcctgtgcagcctctggattcgctttcagtagttatgacatgtcttgggttcgccagactccggagaagagactggagtgggtcgcaaccattagcagtggtggtagttacacctattatccagacagtgtgaagggccgattcaccatctccagagacaatgtcagggacaccctgtacctgcaaatgagcagtttgaggtctgaggacacggccttgtattactgtgcaagacaggcaattgggacgtactttgactactggggccaaggcaccactctcacagtctcctca

SEQ ID NO: 155 - protein, 118 aa, Mus musculus
EVKLVESGGDLVKPGGSLKLSCAASGFAFSSYDMSWVRQTPEKRLEWVATISSGGSYTYYPDSVKGRFTISRDNVRDTLYLQMSSLRSEDTALYYCARQAIGTYFDYWGQGTTLTVSS

SEQ ID NO: 156 - DNA, 321 bp, Mus musculus
  misc_feature (1)..(321): SC16.58 VL
  CDS (1)..(321)
gacatccagatgactcagtctccagcctccctatcttcatctgtgggagaaactgtcaccatcacatgtcgagcaagtgagaatatttacagttatttagcatggtatcagcagaaacagggaaaatctcctcagctcctggtctataatgcaaaaactttagcagaaggtgtgccatcaaggttcagtggcagtggatcaggcacacagttttctctgaagatcaacagcctgcagcctgaagattttgggacttattactgtcaacatcattatgattctccgctcacgttcggtgctgggaccaagctggagctgaga

SEQ ID NO: 157 - protein, 107 aa, Mus musculus
DIQMTQSPASLSSSVGETVTITCRASENIYSYLAWYQQKQGKSPQLLVYNAKTLAEGVPSRFSGSGSGTQFSLKINSLQPEDFGTYYCQHHYDSPLTFGAGTKLELR

SEQ ID NO: 158 - DNA, 360 bp, Mus musculus
  misc_feature (1)..(360): SC16.58 VH
  CDS (1)..(360)
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaacatctactatgcagacacagtgaagggccgattcaccatctccagagacaatcccaagaacaccctgttcctgcaaatgaccagtctaaggtctgaggacacggccatgtattactgtgcaagaggctactatggtaactacgatgctatggactactggggtcaaggaacctcagtcaccgtctcctca

SEQ ID NO: 159 - protein, 120 aa, Mus musculus
DVQLVESGGGLVQPGGSRKLSCAASGFTFSSFGMHWVRQAPEKGLEWVAYISSGSSNIYYADTVKGRFTISRDNPKNTLFLQMTSLRSEDTAMYYCARGYYGNYDAMDYWGQGTSVTVSS

SEQ ID NO: 160 - DNA, 339 bp, Mus musculus
  misc_feature (1)..(339): SC16.61 VL
  CDS (1)..(339)
gatattgtgatgacacagtctacatcctccctggctatgtcagtaggacagaaggtcactatgagctgcaagtccagtcagagccttttaaatagtagcaatcaaaagaattatttggcctggtaccagcaggaaccaggacagtctcctaaacttctggtatcctttgcatccactagggaatctggggtccctgatcgcttcacaggcagtggatctgggacagatttcactcttaccatcagcggtgtgcaggctgaagacctggcagtttattactgtcagcaacattatagcattccgctcacgttcggtgctggaaccaagctggagctgaaa

SEQ ID NO: 161 - protein, 113 aa, Mus musculus
DIVMTQSTSSLAMSVGQKVTMSCKSSQSLLNSSNQKNYLAWYQQEPGQSPKLLVSFASTRESGVPDRFTGSGSGTDFTLTISGVQAEDLAVYYCQQHYSIPLTFGAGTKLELK

SEQ ID NO: 162 - DNA, 360 bp, Mus musculus
  misc_feature (1)..(360): SC16.61 VH
  CDS (1)..(360)
gaggtcctgctccaacggtctggacctgacctggtgaagcctggggcttcagtgacgataccctgcaaggcttctggatacacattcactgactacaacatggactgggtgaagcagagccatggaaagagccttgagtggattggaaatattaatacttacaatggtggtactatctacaaccagaagttcaagggcaaggccacattgactgtagacaagccctccagcacagcctacatggagctccgcagcctgacatctgaggacactgcagtctattactgtgcaagacgtctacggtatgggggacactactttgactactggggccaaggcaccgctctcacagtctcctca

SEQ ID NO: 163 - protein, 120 aa, Mus musculus
EVLLQRSGPDLVKPGASVTIPCKASGYTFTDYNMDWVKQSHGKSLEWIGNINTYNGGTIYNQKFKGKATLTVDKPSSTAYMELRSLTSEDTAVYYCARRLRYGGHYFDYWGQGTALTVSS

SEQ ID NO: 164 - DNA, 321 bp, Mus musculus
  misc_feature (1)..(321): SC16.62 VL
  CDS (1)..(321)
gacatcaagatgacccagtctccatcttccatgtatgcatctctaggagagagagtcactatcacttgcaaggcgagtcaggacattaatagctttttaagctggttccagcggaaaccagggaaatctccgaagaccctgatctatcgtgcaaacagattagtagatggagtcccatcaaggttcactggcagtggatctgggcaagaattttctctcaccatcagcagcctggagtatgaagatttgggaatttattattgtcttcagtatgatgagtttccgtacacgttcggaggggggaccaagctggaaataaaa

SEQ ID NO: 165 - protein, 107 aa, Mus musculus
DIKMTQSPSSMYASLGERVTITCKASQDINSFLSWFQRKPGKSPKTLIYRANRLVDGVPSRFTGSGSGQEFSLTISSLEYEDLGIYYCLQYDEFPYTFGGGTKLEIK

SEQ ID NO: 166 - DNA, 351 bp, Mus musculus
  misc_feature (1)..(351): SC16.62 VH
  CDS (1)..(351)
gaagtgatgctggtagagtctgggggagacttagtgaagcctggagggtccctgaaactctcctgtgcagcctctggattcactttcagtagctatgccatgtcttgggttcgccagactccggagaagaggctggagtgggtcgcatacattagcggtggtggtgatcacatctattatccagacagtgtgaggggccgattcaccatctccagagacaatgccaaggacaccctgtacctgcaaatgagcagtctgaggtctgaggacacggccttgtatgactgtgcaagagtgagagactggtacttcgatgtctggggcgcagggaccacggtcaccgtctcctca

SEQ ID NO: 167 - protein, 117 aa, Mus musculus
EVMLVESGGDLVKPGGSLKLSCAASGFTFSSYAMSWVRQTPEKRLEWVAYISGGGDHIYYPDSVRGRFTISRDNAKDTLYLQMSSLRSEDTALYDCARVRDWYFDVWGAGTTVTVSS

SEQ ID NO: 168 - DNA, 318 bp, Mus musculus
  misc_feature (1)..(318): SC16.63 VL
  CDS (1)..(318)
caaattgttctcacccagtctccagcaatcatgtctgcatctccaggggagaaggtcaccatgacctgcagtgccagctcaagtgtcagttacatgtactggtaccagcagaagtcaggcacctcccccaaaagatggatttatgacacatccaaactggcttctggagtccctgctcgcttcagtggcagtgggtctgggacctcttactctctcacaatcagcagcatggaggctgaagatgctgccacttattactgccagcagtggagtagtaacccgtacacgttcggaggggggaccaagctggaaataaar

SEQ ID NO: 169 - protein, 106 aa, Mus musculus
QIVLTQSPAIMSASPGEKVTMTCSASSSVSYMYWYQQKSGTSPKRWIYDTSKLASGVPARFSGSGSGTSYSLTISSMEAEDAATYYCQQWSSNPYTFGGGTKLEIK

SEQ ID NO: 170 - DNA, 342 bp, Mus musculus
  misc_feature (1)..(342): SC16.63 VH
  CDS (1)..(342)
caggttcagctgcagcagtctggaactgagctgctgaggcctggggcctcagtgaagatatcctgcaaggctactggctacacattcagtagctactggatggagtgggtaaagcagaggcctggacatggccttgagtggattggagagattttacctggaagtggtactactcagtacaatgagaagttcaagggcaaggccaccttcactgcagatacatcctccaacacagcctacatgcatctcagcagcctgacatctgaggactctgccgtctattactgtgcaagagggactaactctctctggggccaagggactctggtcactgtctctgca

SEQ ID NO: 171 - protein, 114 aa, Mus musculus
QVQLQQSGTELLRPGASVKISCKATGYTFSSYWMEWVKQRPGHGLEWIGEILPGSGTTQYNEKFKGKATFTADTSSNTAYMHLSSLTSEDSAVYYCARGTNSLWGQGTLVTVSA

SEQ ID NO: 172 - DNA, 318 bp, Mus musculus
  misc_feature (1)..(318): SC16.65 VL
  CDS (1)..(318)
caaattgttctcacccagtctccagcactcatgtctgcatctccaggggagaaggtcaccatgacctgcagtgtcacctcaagtgtaagttacatgtactggtaccagcagaagcctagatcctcccccaaaccctggatttatctcacatccaacctggcttctggagtccctgctcgcttcagtggcagtgggtctgggacctcttactctctcacaatcagcagcgtggaggctgaagatgctgccacttattactgccagcagtggaggaataacccattcacgttcggctcggggacaaaggtggaaataaaa

SEQ ID NO: 173 - protein, 106 aa, Mus musculus
QIVLTQSPALMSASPGEKVTMTCSVTSSVSYMYWYQQKPRSSPKPWIYLTSNLASGVPARFSGSGSGTSYSLTISSVEAEDAATYYCQQWRNNPFTFGSGTKVEIK

SEQ ID NO: 174 - DNA, 372 bp, Mus musculus
  misc_feature (1)..(372): SC16.65 VH
  CDS (1)..(372)
caggttactctgaaagagtctggccctgggatattgcagccctcccagaccctcagtctgacttgttctttctctgggttttcactgagcacttctggtatgggtgtaggctggattcgtcagccatcagggaagggtctggagtggctggcactcatttggtgggatgatgtcaagcgctataatccagccctgaagagtcgactgactatctccaaggatgcctccagcagccaggtcttcctcaagatcgccagtgtggacactgcagatactgccacatactactgtgctcgaatagcttcctatgattacgacgtagtctatgctatggactactggggtcaaggaacctcagtcagcgtctcctca

SEQ ID NO: 175 - protein, 124 aa, Mus musculus
QVTLKESGPGILQPSQTLSLTCSFSGFSLSTSGMGVGWIRQPSGKGLEWLALIWWDDVKRYNPALKSRLTISKDASSSQVFLKIASVDTADTATYYCARIASYDYDVVYAMDYWGQGTSVSVSS

SEQ ID NO: 176 - DNA, 327 bp, Mus musculus
  misc_feature (1)..(327): SC16.67 VL
  CDS (1)..(327)
caggctgttgtgactcaggaatctgcactcaccacatcacctggtgaaacagtcacactcacttgtcgctcaagtactggggctgttacaactagtaactatgccaactggatccaagaaaaaccagatcatttattcactggtctaataggtggtaccaacaaccgagctccaggtgttcctgccagattctcaggctccctgattggagacaaggctgccctcaccatcacaggggcacagactgaggatgaggcaatatatttctgtggtctatggtacagcaaccatttggtgttcggtggaggaaccaaactgactgtccta

SEQ ID NO: 177 - protein, 109 aa, Mus musculus
QAVVTQESALTTSPGETVTLTCRSSTGAVTTSNYANWIQEKPDHLFTGLIGGTNNRAPGVPARFSGSLIGDKAALTITGAQTEDEAIYFCGLWYSNHLVFGGGTKLTVL

SEQ ID NO: 178 - DNA, 351 bp, Mus musculus
  misc_feature (1)..(351): SC16.67 VH
  CDS (1)..(351)
gaggtgcagcttgttgagactggtggaggattggtgcagcctaaagggtcattgaaactctcatgtgcagtctctgcattcaccttcactacctacgccatgaactgggtccgccaggctccaggaaagggtttggagtgggttgctcgcataagaaataaaagtaataattatgcaacatattatgccgattcagtgaaagacaggttcaccatctccagagatgattcacaaagcatgctctatctgcaaatgaacaacttgaaaattgaggacacagccatgtattactgtgtgttctactatgattacgtctactggggccaagggactctggtcactgtctctgca

SEQ ID NO: 179 - protein, 117 aa, Mus musculus
EVQLVETGGGLVQPKGSLKLSCAVSAFTFTTYAMNWVRQAPGKGLEWVARIRNKSNNYATYYADSVKDRFTISRDDSQSMLYLQMNNLKIEDTAMYYCVFYYDYVYWGQGTLVTVSA

SEQ ID NO: 180 - DNA, 321 bp, Mus musculus
  misc_feature (1)..(321): SC16.68 VL
  CDS (1)..(321)
gaaacaactgtgacccagtctccagcattcctgtccgtggctacaggagaaaaagtcactatcagatgcataaccagcactgatattgatgatgatatgaactggtaccagcagaagccaggggaacctcctaatgtccttatttcagaaggcaatactcttcgtcctggagtcccatcccgattctccagcagtggctatggcacagattttgtttttacaattgaaaacacgctctcagaagatgttgcagattactactgtttgcaaagtgataacatgcctctcacgttcggtgctgggaccaagctggagctgaaa

SEQ ID NO: 181 - protein, 107 aa, Mus musculus
ETTVTQSPAFLSVATGEKVTIRCITSTDIDDDMNWYQQKPGEPPNVLISEGNTLRPGVPSRFSSSGYGTDFVFTIENTLSEDVADYYCLQSDNMPLTFGAGTKLELK

SEQ ID NO: 182 - DNA, 363 bp, Mus musculus
  misc_feature (1)..(363): SC16.68 VH
  CDS (1)..(363)
caggtgcaactgcagcagcctggggctgagctggtgaagcctggggcctcagtgaagatgtcctgcaaggcttctggctacacatttaccaattacaatatgcactgggtaaagcagacacctggacagggcctggaatggattggggctatttttccaggaaatggtggtacttcctacaatcagaagttcaaaggcaaggccacattgactgcagacaaatcctccagcacagcctacatgcagctcaccagtttgacatctggggactctgcagtctattactgtgcaagatggggctacggtagtggcctttatgctatggactactggggtcaaggaacctcagtcaccgtctcctca

SEQ ID NO: 183 - protein, 121 aa, Mus musculus
QVQLQQPGAELVKPGASVKMSCKASGYTFTNYNMHWVKQTPGQGLEWIGAIFPGNGGTSYNQKFKGKATLTADKSSSTAYMQLTSLTSGDSAVYYCARWGYGSGLYAMDYWGQGTSVTVSS

SEQ ID NO: 184 - DNA, 318 bp, Mus musculus
  misc_feature (1)..(318): SC16.72 VL
  CDS (1)..(318)
gaaaatgtactcacccagtctccagcaatcatgtctgcatctctaggggagaaggtcaccatgagctgcagggccagctcaagtgtaaattacatgtcctggtaccagcagaagtcagatgcctcccccaaactatggatttattacacatccaacctggctcctggagtcccagctcgcttcagtggcagtgggtctgggaactcttattctctcacaatcagcagcatggagggtgaagatgctgccacttattactgccagcagtttactagttccccgtacacgttcggaggggggaccaagctggaaataaaa

SEQ ID NO: 185 - protein, 106 aa, Mus musculus
ENVLTQSPAIMSASLGEKVTMSCRASSSVNYMSWYQQKSDASPKLWIYYTSNLAPGVPARFSGSGSGNSYSLTISSMEGEDAATYYCQQFTSSPYTFGGGTKLEIK

SEQ ID NO: 186 - DNA, 351 bp, Mus musculus
  misc_feature (1)..(351): SC16.72 VH
  CDS (1)..(351)
gaggtccagctgcagcagtctggacctgagctggtaaagcctggggcttcagtgaagatgtcctgcaaggcttctggatacacattcactagctatgttatgcactgggtgaagcagaagcctgggcagggccttgagtggattggatatattaatccttacaatgatggtactaagtacaatgagaagttcaaaggcaaggccacactgacttcagacaaatcctccagcacagcctacatggagctcagcagcctgacctctgaggactctgcggtctattactgtgcaagattgaggtcgagggctatggactactggggtcaaggaacctcagtcaccgtctcctca

SEQ ID NO: 187 - protein, 117 aa, Mus musculus
EVQLQQSGPELVKPGASVKMSCKASGYTFTSYVMHWVKQKPGQGLEWIGYINPYNDGTKYNEKFKGKATLTSDKSSSTAYMELSSLTSEDSAVYYCARLRSRAMDYWGQGTSVTVSS

SEQ ID NO: 188 - DNA, 321 bp, Mus musculus
  misc_feature (1)..(321): SC16.73 VL
  CDS (1)..(321)
gacatccagatgacccagtctccatcctccttatctgcctctctgggagagagagtcagtctcacttgtcgggcaagtcaggacattggttatagcttaaactggcttcagcaggaaccagatggaactattaaacgcctgatctacgccacatccagtttagattctggtgtccccaaaaggttcagtggcagtaggtctgggtcagattattctctcaccatcagcagccttgagtctgaagattttgtagactattactgtctacaatatgctagttctccgtggacgttcggtggaggcaccaagctggaaatcaaa

SEQ ID NO: 189 - protein, 107 aa, Mus musculus
DIQMTQSPSSLSASLGERVSLTCRASQDIGYSLNWLQQEPDGTIKRLIYATSSLDSGVPKRFSGSRSGSDYSLTISSLESEDFVDYYCLQYASSPWTFGGGTKLEIK

SEQ ID NO: 190 - DNA, 369 bp, Mus musculus
  misc_feature (1)..(369): SC16.73 VH
  CDS (1)..(369)
caggtgcagctgcagcagtctggagctgagctgatgaagcctggggcctcagtgaagatatcctgcaaggctaatggctacacattcagtagctactggatagagtggttaaggcagaggcctggacatggccttgagtggattggagagattttacctggaagtgataatagtaattataatgagaagttcaagggcaaggccacattcactgcagatacatcctccaacacagcctacatgcaactcagcagcctgacatctgaggaatctgccgtctattactgtacaaggggattacgacgagacggctcatattactatgttatggaacattggggtcaaggaacctcagtcaccgtctcctca

SEQ ID NO: 191 - protein, 123 aa, Mus musculus
QVQLQQSGAELMKPGASVKISCKANGYTFSSYWIEWLRQRPGHGLEWIGEILPGSDNSNYNEKFKGKATFTADTSSNTAYMQLSSLTSEESAVYYCTRGLRRDGSYYYVMEHWGQGTSVTVSS

SEQ ID NO: 192 - DNA, 321 bp, Mus musculus
  misc_feature (1)..(321): SC16.78 VL
  CDS (1)..(321)
gacatcaagatgacccagtctccatcttccatgtatgcatctctaggagagagagtcactatcacttgcaaggcgagtcaggacattaatagctatttaagctggttccagcagaagccagggagatctcctaagaccctgatctatcgtgcaaacagattggtagatggggtcccatcaaggttcagtggcagtggatctgggcaagattattctctcaccatcagcagcctggactatgaagatatgggaatttattattgtctacagtatgatgaatttccattcacgttcggctcggggacaaagttggarathaar

SEQ ID NO: 193 - protein, 107 aa, Mus musculus
DIKMTQSPSSMYASLGERVTITCKASQDINSYLSWFQQKPGRSPKTLIYRANRLVDGVPSRFSGSGSGQDYSLTISSLDYEDMGIYYCLQYDEFPFTFGSGTKLEIK

SEQ ID NO: 194 - DNA, 357 bp, Mus musculus
  misc_feature (1)..(357): SC16.78 VH
  CDS (1)..(357)
gaagtgaagctggtggagtctgggggaggcttagtgaagcctggagggtccctgaaactctcctgtgcagcctctggattcactttcggtcgctatgtcatgtcttgggttcgccagactccagaaaagaaactggagtgggtcgcatccattactagtggtggtactacctactatccagacagtgtgaagggccgattcaccatctccagagataatgccaggaacatcctgtacctacaaatgagcagtctgaggtctgaggacacggccatgtattactgtgcaagagtctactatcattacgacgacatctttgcttactggggccaagggactctggtcactgtctctgca

SEQ ID NO: 195 - protein, 119 aa, Mus musculus
EVKLVESGGGLVKPGGSLKLSCAASGFTFGRYVMSWVRQTPEKKLEWVASITSGGTTYYPDSVKGRFTISRDNARNILYLQMSSLRSEDTAMYYCARVYYHYDDIFAYWGQGTLVTVSA

SEQ ID NO: 196 - DNA, 336 bp, Mus musculus
  misc_feature (1)..(336): SC16.79 VL
  CDS (1)..(336)
gacattgtgatgtcacagtctccatcctccctggctgtgtcagcaggagagaaggtcactatgagctgcaaatccagtcagagtctgctcaacagtagaacccgaaagaactacttggcttggtaccagcagaaaccagggcagtctcctaaactgctgatctactgggcatccactagggaatctggggtccctgatcgcttcacaggcagtggatctgggacagatttcactctcaccatcagcagtgtgcaggctgaagacctggcagtttattactgcaagcaatcttataatctttacacgttcggaggggggaccaagctgaaaataaaa

SEQ ID NO: 197 - protein, 112 aa, Mus musculus
DIVMSQSPSSLAVSAGEKVTMSCKSSQSLLNSRTRKNYLAWYQQKPGQSPKLLIYWASTRESGVPDRFTGSGSGTDFTLTISSVQAEDLAVYYCKQSYNLYTFGGGTKLKIK

SEQ ID NO: 198 - DNA, 348 bp, Mus musculus
  misc_feature (1)..(348): SC16.79 VH
  CDS (1)..(348)
gaggtccagctgcaacagtctggacctgagctggtgaagcctggggcttcagtgaagatatcctgcaagacttctggatacacattcactgaatacaccatgcactgggtgaagcagagccatggaaagagccttgagtggattggaggtattaatcctaacaatggtggtactagctacaaccagaagttcaagggcaaggccacattgactgtagacaagtcctccagcacagcctacatggagctccgcagcctgacatctgaggattctgcagtctattactgtgcaaggggtcccgcctggtttgcttactggggccaagggactctggtcactgtctctgca

SEQ ID NO: 199 - protein, 116 aa, Mus musculus
EVQLQQSGPELVKPGASVKISCKTSGYTFTEYTMHWVKQSHGKSLEWIGGINPNNGGTSYNQKFKGKATLTVDKSSSTAYMELRSLTSEDSAVYYCARGPAWFAYWGQGTLVTVSA

SEQ ID NO: 200 - DNA, 321 bp, Mus musculus
  misc_feature (1)..(321): SC16.80 VL
  CDS (1)..(321)
gaaacaactgtgacccagtctccagcatccctgtccatggctataggagaaaaagtcaccatcagatgcataaccagcactgatattgatgatgatatgatctggtaccagcagaagccaggggaacctcctaagctccttatttcagaaggcaatactcttcgtcctggagtcccatcccgattctccagcagtggctatggtacagattttgtttttacaattgaaaacatgctctcagaagatgttgccgattactactgtttgaaaagggatgacttgccttacacgttcggcggggggacacaggtggaaattaaa

SEQ ID NO: 201 - protein, 107 aa, Mus musculus
ETTVTQSPASLSMAIGEKVTIRCITSTDIDDDMIWYQQKPGEPPKLLISEGNTLRPGVPSRFSSSGYGTDFVFTIENMLSEDVADYYCLKRDDLPYTFGGGTQVEIK

SEQ ID NO: 202 - DNA, 351 bp, Mus musculus
  misc_feature (1)..(351): SC16.80 VH
  CDS (1)..(351)
gaggtccagctgcaacagtctggacctgagctggtgaagcctggaggttcaaagaagatatcctgcaaggcttctggttactcattcactggctacagtatgaactgggtgaagcagagccatggaaagaaccttgagtggattggacttattaatccttacagtggtggtactatctacaaccagaaattcaagggcaaggccacattaactgtagacaagtcatccagcacagcctacatggagctcctcagtctgacatctgaggactctgcagtctattactgtgcaagaaggagtgattacccgttagtttactggggccaagggactctggtcactgtctctgca

SEQ ID NO: 203 - protein, 117 aa, Mus musculus
EVQLQQSGPELVKPGGSKKISCKASGYSFTGYSMNWVKQSHGKNLEWIGLINPYSGGTIYNQKFKGKATLTVDKSSSTAYMELLSLTSEDSAVYYCARRSDYPLVYWGQGTLVTVSA

SEQ ID NO: 204 - DNA, 324 bp, Mus musculus
  misc_feature (1)..(324): SC16.81 VL
  CDS (1)..(324)
caaattgttctcacccagtctccagcaatcatgtctgcatctctaggggaacgggtcaccctgacctgcactgccagctcaagtgtaagttccagttacttgcactggtaccagcagaagccaggatcctcccccaaactctggatttatagcacatccaacctggcttctggagtcccaactcgcttcagtggcagtgggtctgggacctcttactctctcagaatcagcagcatggaggctgaagatgctgccacttattactgccaccagtataatcgttccccgctcacgttcggtgctgggaccaagctggagctgaaa

SEQ ID NO: 205 - protein, 108 aa, Mus musculus
QIVLTQSPAIMSASLGERVTLTCTASSSVSSSYLHWYQQKPGSSPKLWIYSTSNLASGVPTRFSGSGSGTSYSLRISSMEAEDAATYYCHQYNRSPLTFGAGTKLELK

SEQ ID NO: 206 - DNA, 351 bp, Mus musculus
  misc_feature (1)..(351): SC16.81 VH
  CDS (1)..(351)
caggtgcagctgaaggagtcaggacctgtcctggtggcgccctcacagagcctgtccatcacttgcactgtctctgggttttcattaaccagctatggtgtacactgggttcgccagcctccaggaaagggtctggagtggctgggagtaatttgggctggtggaagtacaaattataattcagctctcatgtccagactgagcatcagcaaagacaactccaagagccaagttttcttaaaaatgaacagtctgcaaactgatgacacagccatgtactactgtgccaaacagggcaacttctatgctatggactactggggtcaaggaacctcagtcaccgtctcctca

SEQ ID NO: 207 - protein, 117 aa, Mus musculus
QVQLKESGPVLVAPSQSLSITCTVSGFSLTSYGVHWVRQPPGKGLEWLGVIWAGGSTNYNSALMSRLSISKDNSKSQVFLKMNSLQTDDTAMYYCAKQGNFYAMDYWGQGTSVTVSS

SEQ ID NO: 208 - DNA, 318 bp, Mus musculus
  misc_feature (1)..(318): SC16.84 VL
  CDS (1)..(318)
gacatccagatgacacagtctccatcctcactgtctgcatctctgggaggcaaagtcaccatcacttgcaaggcaagccaagacattaagaagtatatagcttggtaccaacacaagcctggaaaaggtcctaggctactcatacattacacatctacattagagccaggcatcccatcaaggttcagtggaagtgggtctgggagagattattccttcagcatcagcaacctggagcctgaagatattgcaacttattattgtctacaatatgatattctgtggacgttcggtggaggcaccaagctggaaatcaaa

SEQ ID NO: 209 - protein, 106 aa, Mus musculus
DIQMTQSPSSLSASLGGKVTITCKASQDIKKYIAWYQHKPGKGPRLLIHYTSTLEPGIPSRFSGSGSGRDYSFSISNLEPEDIATYYCLQYDILWTFGGGTKLEIK

SEQ ID NO: 210 - DNA, 363 bp, Mus musculus
  misc_feature (1)..(363): SC16.84 VH
  CDS (1)..(363)
gaggtccagctgcaacagtctggacctgagctggtgaagcctggagcttcaatgaagatatcctgcaaggcttctggttactcattcactggctacaccatgaactgggtgaagcagagccatggaaagaaccttgagtggattggacttattaatccttacaatggtggtactacctacaaccagaagttcaagggcaaggccacattaactgtagacaagtcatccagcacagcctacatggagctcctcagtctgacatctgaggactctgcagtctattactgtgcattaggttactatggtaactacaggaggtacttcgatgtctggggcgcagggaccacggtcaccgtctcctca

SEQ ID NO: 211 - protein, 121 aa, Mus musculus
EVQLQQSGPELVKPGASMKISCKASGYSFTGYTMNWVKQSHGKNLEWIGLINPYNGGTTYNQKFKGKATLTVDKSSSTAYMELLSLTSEDSAVYYCALGYYGNYRRYFDVWGAGTTVTVSS

SEQ ID NO: 212 - DNA, 324 bp, Mus musculus
  misc_feature (1)..(324): SC16.88 VL
  CDS (1)..(324)
gaaaatgtgctcacccagtctccagcaataatggctgcctctctggggcagaaggtcaccatgacctgcagtgccagctcaagtgtaagttccagttacttgcactggtaccagcagaagtcaggcgcttcccccaaacccttgattcataggacatccaacctggcttctggagtcccagctcgcttcagtggcagtgggtctgggacctcttactctctcacaatcagcagcgtggaggctgaagatgatgcaacttattactgccggcagtggagtggttacccgtggacgttcggtggaggcaccaagctggaaatcaaa

SEQ ID NO: 213 - protein, 108 aa, Mus musculus
ENVLTQSPAIMAASLGQKVTMTCSASSSVSSSYLHWYQQKSGASPKPLIHRTSNLASGVPARFSGSGSGTSYSLTISSVEAEDDATYYCRQWSGYPWTFGGGTKLEIK

SEQ ID NO: 214 - DNA, 357 bp, Mus musculus
  misc_feature (1)..(357): SC16.88 VH
  CDS (1)..(357)
caggttcagctgcagcagtctggggctgagctggcaagacctggggcttcagtgaagttgtcctgcaaggcttctggctacacctgtactagctactggatgcagtgggtaaaacagaggcctggacagggtctggaatggattggggctatttatcctggagatggtgatactaggtacactcagaagttcaagggcaaggccacattgactgcagataaatcctccagcacagcctacatgcaactcagcagcttggcatctgaggactctgcggtctattactgtgcaagggggaggcggacggaggcctggtttgcttactggggccaagggactctggtcactgtctctgca

SEQ ID NO: 215 - protein, 119 aa, Mus musculus
QVQLQQSGAELARPGASVKLSCKASGYTCTSYWMQWVKQRPGQGLEWIGAIYPGDGDTRYTQKFKGKATLTADKSSSTAYMQLSSLASEDSAVYYCARGRRTEAWFAYWGQGTLVTVSA

SEQ ID NO: 216 - DNA, 324 bp, Mus musculus
  misc_feature (1)..(324): SC16.101 VL
  CDS (1)..(324)
caaattgttctcacccagtctccagcaatcatgtctgcatctctaggggaacgggtcaccatgacctgcactgccagctcaagtgtaagttccagttacttgcactggtaccagcagaagccaggatcctcccccaaactctggatttatagcacatccaacctggcttctggagtcccagctcgcttcagtggcagtgagtctgggacctcttactctctcacaatcagcaacatggaggctgaggatgctgccacttattactgccaccagtatcatcgttccccattcacgttcggctcggggacaaagttggaaataaaa

SEQ ID NO: 217 - protein, 108 aa, Mus musculus
QIVLTQSPAIMSASLGERVTMTCTASSSVSSSYLHWYQQKPGSSPKLWIYSTSNLASGVPARFSGSESGTSYSLTISNMEAEDAATYYCHQYHRSPFTFGSGTKLEIK

SEQ ID NO: 218 - DNA, 360 bp, Mus musculus
  misc_feature (1)..(360): SC16.101 VH
  CDS (1)..(360)
caggttactctgaaagagtctggccctgggatattgcagccctcccagaccctcagtctgacttgttctttctctggattttcactgagcacttctggtatgggcgtaggctggattcgtcagccatcagggaagggtctggagtggctggcacacatttggtgggatgatgtcaagcgctataacccagcccttaagagccgactgactatctccaaggatgcctccagcagccaggtattcctcaagatcgccagtgtggacactgcagaaactgccacatactactgtgcccacatcctcgaccgggcttactactttgactactggggccaaggcaccactctcacagtcacctca

SEQ ID NO: 219 - protein, 120 aa, Mus musculus
QVTLKESGPGILQPSQTLSLTCSFSGFSLSTSGMGVGWIRQPSGKGLEWLAHIWWDDVKRYNPALKSRLTISKDASSSQVFLKIASVDTAETATYYCAHILDRAYYFDYWGQGTTLTVTS

SEQ ID NO: 220 - DNA, 333 bp, Mus musculus
  misc_feature (1)..(333): SC16.103 VL
  CDS (1)..(333)
gacattgtgctgacacagtctcctgcttccttagctgtatctctggggcagagggccaccatctcatgcagggccagcaaaagtgtcagtacatctggctatagttatatgcactggtaccaacagaaaccaggacagccacccaaactcctcatctatcttgcatccaacctagaatctggggtccctgccaggttcagtggcagtgggtctgggacagacttcaccctcaacatccatcctgtggaggaggaggatgctgcaacctattactgtcagcacagtagggagcttcctctcacgttcggtgctgggaccaagctggagctgaaa

SEQ ID NO: 221 - protein, 111 aa, Mus musculus
DIVLTQSPASLAVSLGQRATISCRASKSVSTSGYSYMHWYQQKPGQPPKLLIYLASNLESGVPARFSGSGSGTDFTLNIHPVEEEDAATYYCQHSRELPLTFGAGTKLELK

SEQ ID NO: 222 - DNA, 357 bp, Mus musculus
  misc_feature (1)..(357): SC16.103 VH
  CDS (1)..(357)
caagttactctaaaagagtctggccctgggatattgaagccctcacagaccctcagtctgacttgttctttctctgggttttcactgagcacttctggtatgggtataggctggattcgtcagccttcagggaagggtctggagtggctggcacacatttggtgggatgatgataagtactataacccatccctgaagagccagctcacaatctccaaggattcctccagaaaccaggttttcctcaagatcaccagtgtggacactgcagatactgccacttactactgtgctcgaagagggactgcgtactactttgactactggggccaaggcaccactctcacagtctcctca

SEQ ID NO: 223 - protein, 119 aa, Mus musculus
QVTLKESGPGILKPSQTLSLTCSFSGFSLSTSGMGIGWIRQPSGKGLEWLAHIWWDDDKYYNPSLKSQLTISKDSSRNQVFLKITSVDTADTATYYCARRGTAYYFDYWGQGTTLTVSS

SEQ ID NO: 224 - DNA, 318 bp, Mus musculus
  misc_feature (1)..(318): SC16.104 VL
  CDS (1)..(318)
caaattgttctctcccagtctccagcaatcctgtctgcatctccaggggagaaggtcacaatgacttgcagggccagttcaagtgtaagttacattcactggtaccggcagaagccaggatcctcccccaaaccctggatttatgccacatccaacctggcttctggagtccctgctcgcttcagtggcagtgggtctgggacctcttactctctcacaatcagcagagtggaggctgaagatgctgccacttattactgccagcagtggagcagtaatccacccacgttcggtgctgggaccaagctggagctgaaa

SEQ ID NO: 225 - protein, 106 aa, Mus musculus
QIVLSQSPAILSASPGEKVTMTCRASSSVSYIHWYRQKPGSSPKPWIYATSNLASGVPARFSGSGSGTSYSLTISRVEAEDAATYYCQQWSSNPPTFGAGTKLELK

SEQ ID NO: 226 - DNA, 345 bp, Mus musculus
  misc_feature (1)..(345): SC16.104 VH
  CDS (1)..(345)
caggtgcagctgaaggagtcaggacctgaccttgtgcagccctcacagaccctgtctctcacctgcactgtctctgggttctcattaaccttctatggtgttcactgggttcgccagcctccaggaaagggactggagtgggtgggaacaatgggctgggatgacaaaaaatattataattcagctctaaaatctcgactgagcatcagcagggatacctccaagaaccaggttttcttaaaactgagcagtctgcaaactgaagacacagccatgtactactgtactagaggtgggacggggtttgactactggggccaaggcaccactctcacagtctcctca

SEQ ID NO: 227 - protein, 115 aa, Mus musculus
QVQLKESGPDLVQPSQTLSLTCTVSGFSLTFYGVHWVRQPPGKGLEWVGTMGWDDKKYYNSALKSRLSISRDTSKNQVFLKLSSLQTEDTAMYYCTRGGTGFDYWGQGTTLTVSS

SEQ ID NO: 228 - DNA, 321 bp, Mus musculus
  misc_feature (1)..(321): SC16.105 VL
  CDS (1)..(321)
gacattgtgatgacccagtcgcacaaattcatgtccacatcagtaggagacagggtcagcatcacctgcaaggccagtcaggatgtgggtactgctgtagcctggtatcaacagaaaccagggcaatctcctaaactactgatttactgggcatccatccggcacactggagtccctgatcgcttcacaggcagtggatctgggacagatttcactctcaccattagcaatgtgcagtctgaagacttggcagattatttctgtcagcaatatagcagctatccgctcacgttcggtgctgggaccaagctggagctgaaa

SEQ ID NO: 229 - protein, 107 aa, Mus musculus
DIVMTQSHKFMSTSVGDRVSITCKASQDVGTAVAWYQQKPGQSPKLLIYWASIRHTGVPDRFTGSGSGTDFTLTISNVQSEDLADYFCQQYSSYPLTFGAGTKLELK

SEQ ID NO: 230 - DNA, 363 bp, Mus musculus
  misc_feature (1)..(363): SC16.105 VH
  CDS (1)..(363)
caggtccaactgcagcagcctggggctgagcttgtgaagcctggggcttcagtgaagctgtcctgcaaggcttctggctacaccttcaccagctactggatgcactgggtgaagcagaggcctggacaaggccttgagtggattggagtgattaatcctagcaacggtcgtactaactacaatgagaagttcaagagcaaggccacactgactgtagacaaatcctccagcacagcctacatgcaactcagcagcctgacatctgaggactctgcggtctattactgtgcaagaagaagggaactgggaaccctctatgctatggactactggggtcaaggaacctcagtcaccgtctcctca

SEQ ID NO: 231 - protein, 121 aa, Mus musculus
QVQLQQPGAELVKPGASVKLSCKASGYTFTSYWMHWVKQRPGQGLEWIGVINPSNGRTNYNEKFKSKATLTVDKSSSTAYMQLSSLTSEDSAVYYCARRRELGTLYAMDYWGQGTSVTVSS

SEQ ID NO: 232 - DNA, 321 bp, Mus musculus
  misc_feature (1)..(321): SC16.106 VL
  CDS (1)..(321)
gacatcaagatgacccagtctccatcttccatgtatgcatctctaggagagagagtcactatcacttgcaaggcgagtcaggacattaatagctatttaagctggttccagcagaaaccagggaaatctcctaagaccctgatctatcgtgcaaacagattggtagatggggtcccatcaaggttcagtggcagtggatctgggcaagattattctctcaccatcagcagcctggagtatgaagatatgggaatttattattgtctacagtatgatgagtttccattcacgttcggctcggggacaaagttggaaataaaa

SEQ ID NO: 233 - protein, 107 aa, Mus musculus
DIKMTQSPSSMYASLGERVTITCKASQDINSYLSWFQQKPGKSPKTLIYRANRLVDGVPSRFSGSGSGQDYSLTISSLEYEDMGIYYCLQYDEFPFTFGSGTKLEIK

SEQ ID NO: 234 - DNA, 345 bp, Mus musculus
  misc_feature (1)..(345): SC16.106 VH
  CDS (1)..(345)
caggtgcaactgaagcagtcaggacctggcctggtggcgccctcacagagcctgttcatcacatgcaccgtctcagggttctcattaaccagctatgaaataaactgggttcgccagcctccaggaaagggtctggagtggctgggagtgatatggactggtggaagcacaaattataattcagctctcatatccagactgagcatcagcaaagacaactccaagagcctagttttcttaaaaatgaacagtctgcaaactgatgacacagccatatattactgtgtaagaggtgtttatgctatggactactggggtcaaggaacctcagtcaccgtctcctca

SEQ ID NO: 235 - protein, 115 aa, Mus musculus
QVQLKQSGPGLVAPSQSLFITCTVSGFSLTSYEINWVRQPPGKGLEWLGVIWTGGSTNYNSALISRLSISKDNSKSLVFLKMNSLQTDDTAIYYCVRGVYAMDYWGQGTSVTVSS

SEQ ID NO: 236 - DNA, 321 bp, Mus musculus
  misc_feature (1)..(321): SC16.107 VL
  CDS (1)..(321)
gacattgtgatgacccagtctcacaaattcatgtccacatcagtaggagacagggtcagcatcacctgcaaggccagtcaggatgtgaatactgctgtaggctggtatcaacagaaaccaggacaatctcctaaactactgatttactcggcatcctaccggtacactggagtccctgatcgcttcactggcagtggatctgggacggatttcactttcaccatcagcagtgtgcaggctgaagacctggcagtttattactgtcagcaacattatagtagtccgtacacgttcggaggggggaccaaggtggaaataaaa

SEQ ID NO: 237 - protein, 107 aa, Mus musculus
DIVMTQSHKFMSTSVGDRVSITCKASQDVNTAVGWYQQKPGQSPKLLIYSASYRYTGVPDRFTGSGSGTDFTFTISSVQAEDLAVYYCQQHYSSPYTFGGGTKVEIK

SEQ ID NO: 238 - DNA, 357 bp, Mus musculus
  misc_feature (1)..(357): SC16.107 VH
  CDS (1)..(357)
gaggtccagctgcagcagtctggacctgagctggtaaagcctggggcttcagtgaagatgtcctgcaaggcttctggatacacattcactaactatgttatgcactgggtgaagcagaagcctgggcagggccttgagtggattggatatattaatccttacaatgatggtactaaatacaatgagaagttcaaaggcaaggccacactgacttcagacaaatcctccaccacagcctacatggcgctcagcagcctgacctctgaggactctgcggtctattactgtgcagtagcctactatagtaactgggggtttgcttactggggccaagggactctggtcactgtctctgca

SEQ ID NO: 239 - protein, 119 aa, Mus musculus
EVQLQQSGPELVKPGASVKMSCKASGYTFTNYVMHWVKQKPGQGLEWIGYINPYNDGTKYNEKFKGKATLTSDKSSTTAYMALSSLTSEDSAVYYCAVAYYSNWGFAYWGQGTLVTVSA

SEQ ID NO: 240 - DNA, 321 bp, Mus musculus
  misc_feature (1)..(321): SC16.108 VL
  CDS (1)..(321)
gacatccagatgactcagtctccagcctccctatctgcatctgtgggagaaactgtcaccatcacatgtcgagcaagtgagaatatttacagttatttagcatggtatcagcagaaacagggaaaatctcctcagctcctggtctataatgcaaaaaccttagcagaaggtgtgccatcaaggttcagtggcagtagatcaggctcacagttttctctgaagatcaacagcctgcagcctgaagattttgggagttattactgtcaacatcattatggtactccgtacacgttcggaggggggaccaagctggaaataaaa

SEQ ID NO: 241 - protein, 107 aa, Mus musculus
DIQMTQSPASLSASVGETVTITCRASENIYSYLAWYQQKQGKSPQLLVYNAKTLAEGVPSRFSGSRSGSQFSLKINSLQPEDFGSYYCQHHYGTPYTFGGGTKLEIK

SEQ ID NO: 242 - DNA, 360 bp, Mus musculus
  misc_feature (1)..(360): SC16.108 VH
  CDS (1)..(360)
caggttcagctggaggagtcaggggctgagctggcaagacctggggcttcagtgaagttgtcctgcaaggcttctggctatagctactggatgcagtggataaaacagaggcctggacagggtctggaatggattggggctatttatcctggaaatggtgatactaggtacactcagaagttcaagggcaaggccacattgactgcagataaatcctccagcacagcctacatgcaactcagcagcttggcatctgaggactctgcggtctattactgtgcaagatctccggcctactataggtacggcgagggctactttgactactggggccaaggcaccactctcacagtctcctca

SEQ ID NO: 243 - protein, 120 aa, Mus musculus
QVQLEESGAELARPGASVKLSCKASGYSYWMQWIKQRPGQGLEWIGAIYPGNGDTRYTQKFKGKATLTADKSSSTAYMQLSSLASEDSAVYYCARSPAYYRYGEGYFDYWGQGTTLTVSS

SEQ ID NO: 244 - DNA, 318 bp, Mus musculus
  misc_feature (1)..(318): SC16.109 VL
  CDS (1)..(318)
caaattgttctcacccagtctccagcaatcatgtctgcatctccaggggagaaggtcaccatgacctgcagtgccagctcaagtgtaagttacatgtactggtaccagcagaagccaggatcctcccccagactcctgatttatgacacatccaacctggcttctggagtccctgttcgcttcagtggcagtgggtctgggacctctttctctctcacaatcagccgaatggaggctgaagatactgccacttattactgccaggagtggagtggtaatccgctcacgttcggtgatgggaccaagctggagctgaaa

SEQ ID NO: 245 - protein, 106 aa, Mus musculus
QIVLTQSPAIMSASPGEKVTMTCSASSSVSYMYWYQQKPGSSPRLLIYDTSNLASGVPVRFSGSGSGTSFSLTISRMEAEDTATYYCQEWSGNPLTFGDGTKLELK

SEQ ID NO: 246 - DNA, 354 bp, Mus musculus
  misc_feature (1)..(354): SC16.109 VH
  CDS (1)..(354)
cagatccagttggtgcagtctggacctgagctgaagaagcctggagagacagtcaagatctcctgcaaggcttctgggtataccttcacaaactatggaatgaactgggtgaagcaggctccaggaaagggtttaaagtggatgggctggataaacacctacactggagagccagcatatgctgatgacttcaagggacggtttgccttctctttggaaacctctgccagcgctgcctatttgcagatcaacaacctcaaaaatgaggacacggctacttttttctgtgcaaatatgaggcccacgagggggtttgcttactgggggcaagggactctgggcactgtctctgca

SEQ ID NO: 247 - protein, 118 aa, Mus musculus
QIQLVQSGPELKKPGETVKISCKASGYTFTNYGMNWVKQAPGKGLKWMGWINTYTGEPAYADDFKGRFAFSLETSASAAYLQINNLKNEDTATFFCANMRPTRGFAYWGQGTLGTVSA

SEQ ID NO: 248 - DNA, 321 bp, Mus musculus
  misc_feature (1)..(321): SC16.110 VL
  CDS (1)..(321)
aatattgtgatgacccagactcccaaattcctgcttgtatcagcaggagacagggttaccataacctgcaaggccagtcagagtgtgagtaatgatgtagcttggtaccaacagaagccagggcagtctcctaaactgctgatatactatgcatccaatcgctacactggagtccctgatcgcttcactggcagtggatatgggacggatttcactttcaccatcagcactgtgcaggctgaagacctggcagtttatttctgtcagcaggattatagctctcctccgacgttcggtggaggcaccaagctggaaatcaaa

SEQ ID NO: 249 - protein, 107 aa, Mus musculus
NIVMTQTPKFLLVSAGDRVTITCKASQSVSNDVAWYQQKPGQSPKLLIYYASNRYTGVPDRFTGSGYGTDFTFTISTVQAEDLAVYFCQQDYSSPPTFGGGTKLEIK

SEQ ID NO: 250 - DNA, 354 bp, Mus musculus
  misc_feature (1)..(354): SC16.110 VH
  CDS (1)..(354)
gaggtccagctgcagcagtctggacctgggctagtgaggactggggcttcagtgaagatatcctgcaaggcttctggttactcattcactggttactacatgcactgggtcaagcagagccatggaaagagccttgagtggattggatatattagttgttacaatggtgctactacctacaaccagaacttcaagggcaaggccacatttattgtagacacatcctccagcacagcctacatgcagttcaacagcctgacatctgaggactctgcggtctattactgtgcaagatccgacggggggcatgctatggactactggggtcaaggaacctcagtcaccgtctcctca

SEQ ID NO: 251 - protein, 118 aa, Mus musculus
EVQLQQSGPGLVRTGASVKISCKASGYSFTGYYMHWVKQSHGKSLEWIGYISCYNGATTYNQNFKGKATFIVDTSSSTAYMQFNSLTSEDSAVYYCARSDGGHAMDYWGQGTSVTVSS

SEQ ID NO: 252 - DNA, 321 bp, Mus musculus
  misc_feature (1)..(321): SC16.111 VL
  CDS (1)..(321)
gacatccagatgactcagtctccagcctccctggctgcatctgtgggagaaactgtcaccatcacatgtcgagcaagtgagaacatttactacagtttagcatggtatcagcagaagcaagggaaatctcctcagctcctgatctataatgcaaacagcttggaagatggtgtcccatcgaggttcagtggcagtggatctgggacacagtattctatgaagatcaacagcatgcagcctgaagataccgcaacttatttctgtaagcagacttatgacgttccgctcacgttcggtgctgggaccaagctggagctgaaa

SEQ ID NO: 253 - protein, 107 aa, Mus musculus
DIQMTQSPASLAASVGETVTITCRASENIYYSLAWYQQKQGKSPQLLIYNANSLEDGVPSRFSGSGSGTQYSMKINSMQPEDTATYFCKQTYDVPLTFGAGTKLELK

SEQ ID NO: 254 - DNA, 351 bp, Mus musculus
  misc_feature (1)..(351): SC16.111 VH
  CDS (1)..(351)
gaggttcagctgcagcagtctggacctgagctggagaagcctggcgcttcagtgaagatatcctgcaaggcttctggttactcattcactggctacaacatgaactgggtgaagcagagcaatggaaagagccttgagtggattggaaatattgatccttattatggtggttctagctacaaacagaagttcgagggcaaggccacattgactgtagacaaatcctccagcacagcctacatgcagctcaagagcctgacatctgaggactctgcagtctattactgtgcaagaggtggtagtaacttctttgactactggggccaaggcaccactctcacagtctcctca

SEQ ID NO: 255 - protein, 117 aa, Mus musculus
EVQLQQSGPELEKPGASVKISCKASGYSFTGYNMNWVKQSNGKSLEWIGNIDPYYGGSSYKQKFEGKATLTVDKSSSTAYMQLKSLTSEDSAVYYCARGGSNFFDYWGQGTTLTVSS

SEQ ID NO: 256 - DNA, 336 bp, Mus musculus
  misc_feature (1)..(336): SC16.113 VL
  CDS (1)..(336)
gatgttgtgatgacccagactccactcactttgtcggttaccattggacaaccagcctccatctcttgcaagtcaagtcagagcctcttagatagtgatggaacgacatatttgaattggttgttacagaggccaggccagtctccaaagcgcctaatctatctggtgtctaaactggactctggagtccctgacaggttcactggcagtggatcagggacagatttcacactgaaaatcagcagagtggaggctgaggatttgggagtttattattgctggcaaggtacacattttccgctcacgttcggtgctgggaccaagctggagctgaaa

SEQ ID NO: 257 - protein, 112 aa, Mus musculus
DVVMTQTPLTLSVTIGQPASISCKSSQSLLDSDGTTYLNWLLQRPGQSPKRLIYLVSKLDSGVPDRFTGSGSGTDFTLKISRVEAEDLGVYYCWQGTHFPLTFGAGTKLELK

SEQ ID NO: 258 - DNA, 351 bp, Mus musculus
  misc_feature (1)..(351): SC16.113 VH
  CDS (1)..(351)
gacgtgaagctggtggagtctgggggaggcttagtgaagcctggagggtccctgaaactctcctgtgcagcctctggattcactttcagtagctataccatgtcttgggttcgccagactccggagaagaggctggagtgggtcgcaaccattagtagtggtggtagttacccctactatccagacagtgtgaagggccgattcaccatctccagagacaatgccaagaacaccctgtacctgcaaatgagcagtctgaagtctgaggacacagccatgtattactgtacaagagatgtctatgatggttactcctactggggccaaggcaccactctcacagtctcctca

SEQ ID NO: 259 - protein, 117 aa, Mus musculus
DVKLVESGGGLVKPGGSLKLSCAASGFTFSSYTMSWVRQTPEKRLEWVATISSGGSYPYYPDSVKGRFTISRDNAKNTLYLQMSSLKSEDTAMYYCTRDVYDGYSYWGQGTTLTVSS

SEQ ID NO: 260 - DNA, 318 bp, Mus musculus
  misc_feature (1)..(318): SC16.114 VL
  CDS (1)..(318)
caaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccacatccaacctggcttctggagtccctgctcgcttcagtggcagtgggtctgggacctcttactctctcacaatcagcagagtggaggctgaagatgctgccacttattactgccagcagtggagtagtaacccatacacgttcggaggggggaccaagctggaaataaaa

SEQ ID NO: 261 - protein, 106 aa, Mus musculus
QIVLSQSPAILSASPGEKVTMTCRASSSVSYMHWYQQKPGSSPKPWIYATSNLASGVPARFSGSGSGTSYSLTISRVEAEDAATYYCQQWSSNPYTFGGGTKLEIK

SEQ ID NO: 262 - DNA, 369 bp, Mus musculus
  misc_feature (1)..(369): SC16.114 VH
  CDS (1)..(369)
gaggttcagctgcagcagtctggggcagaacttgtgaagccaggggcctcagtcaaattgtcctgcacagcttctggcttcaacattaaagacacctatatacactgggtgaaacagaggcctgaacagggcctggagtggattggaaggattgatcctgcgaatggtaatactaaatatgacccgaagttccagggcaaggccactataacaccagacacatcctccaacacagcctacctgcagctcagcagcctgacatctgaggacactgccgtctattactgtgctagaagctggcgaaactacggtagtagtttctggtacttcgatgtctggggcgcagggaccacggtcaccgtctcctca

SEQ ID NO: 263 - protein, 123 aa, Mus musculus
EVQLQQSGAELVKPGASVKLSCTASGFNIKDTYIHWVKQRPEQGLEWIGRIDPANGNTKYDPKFQGKATITPDTSSNTAYLQLSSLTSEDTAVYYCARSWRNYGSSFWYFDVWGAGTTVTVSS

SEQ ID NO: 264 - DNA, 336 bp, Mus musculus; identical to SEQ ID NO: 256
  misc_feature (1)..(336): SC16.115 VL
  CDS (1)..(336)

SEQ ID NO: 265 - protein, 112 aa, Mus musculus; identical to SEQ ID NO: 257

SEQ ID NO: 266 - DNA, 351 bp, Mus musculus; identical to SEQ ID NO: 258
  misc_feature (1)..(351): SC16.115 VH
  CDS (1)..(351)

SEQ ID NO: 267 - protein, 117 aa, Mus musculus; identical to SEQ ID NO: 259

SEQ ID NO: 268 - DNA, 333 bp, Mus musculus
  misc_feature (1)..(333): SC16.116 VL
  CDS (1)..(333)
gacattgtgatgacacagtctccatcctccctgactgtgacagcaggagagaaggtcactatgagctgcacgtccagtcagagtctgttaaccagtggaaatcaaaagaactacttgacctggtaccagcagaaaccagggcagcctcctaaactgttgatctactgggcatccactagggaatctggggtccctgatcgcttcacaggcagtggatctggaacagatttcactctcaccatcagcagtttgcaggctgaagacctggcagtttattactgtcagaatgattatagtctcacgttcggtgctgggaccaagctggagctgaaa

SEQ ID NO: 269 - protein, 111 aa, Mus musculus
DIVMTQSPSSLTVTAGEKVTMSCTSSQSLLTSGNQKNYLTWYQQKPGQPPKLLIYWASTRESGVPDRFTGSGSGTDFTLTISSLQAEDLAVYYCQNDYSLTFGAGTKLELK

SEQ ID NO: 270 - DNA, 354 bp, Mus musculus
  misc_feature (1)..(354): SC16.116 VH
  CDS (1)..(354)
caggtgcagctgaagcagtcaggacctggccgagtgcagccctcacagagcctgtccatcacctgcacagtctctggtttttcattaactagcaatggtgtacactgggttcgccagtctccaggaaagggtctggagtggctgggagtgctatggagtggtggaagcacagactataatgcagctttcatatccagactgagcatcagcaaggacaattacaagagccaagttttctttaaaatgaacagtctgcaagctaatgacacagccatatattactgtgccagaaataataataggtacggagctatggactactggggtcaaggaacctcagtcaccgtctcctca

SEQ ID NO: 271 - protein, 118 aa, Mus musculus
QVQLKQSGPGRVQPSQSLSITCTVSGFSLTSNGVHWVRQSPGKGLEWLGVLWSGGSTDYNAAFISRLSISKDNYKSQVFFKMNSLQANDTAIYYCARNNNRYGAMDYWGQGTSVTVSS

SEQ ID NO: 272 - DNA, 321 bp, Mus musculus
  misc_feature (1)..(321): SC16.117 VL
  CDS (1)..(321)
gacatccagatgaaccagtctccatccagtctgtctgcatcccttggagacacaattaccatcacttgccatgtcagtcagaacattaatgtttggttaagctggtaccagcagaaaccaggaaatattcctaaactattgatccaaaaggcttccaacttgcacacaggcgtcccctcaaggtttagtggcagtggatctggaacaggtttcacattaaccatcagcagcctgcagcctgaagacattgccacttactactgtcaacagggtcaaagttatccattcacgttcggctcggggacaaagttggaaataaaa

SEQ ID NO: 273 - protein, 107 aa, Mus musculus
DIQMNQSPSSLSASLGDTITITCHVSQNINVWLSWYQQKPGNIPKLLIQKASNLHTGVPSRFSGSGSGTGFTLTISSLQPEDIATYYCQQGQSYPFTFGSGTKLEIK

SEQ ID NO: 274 - DNA, 351 bp, Mus musculus
  misc_feature (1)..(351): SC16.117 VH
  CDS (1)..(351)
caggtgcagctgaaggagtcaggacctggcctggtggcgccctcacagagcctgtccatcacttgcactgtctctgggttttcattaaccaactatggtgtacactgggttcgccagcctccaggaaagggtctggagtggctgggagtaatatgggctggtggaatcacaaattataattcggctctcatgtccagactgagcatcagcgaagacaactccaagagccaagttttcttaaaaatgaacagtctgcaaactgatgacacagccatgtactactgtgccagaaatttaggtccctatgctatggactactggggtcaaggaacctcagtcaccgtctcctca

SEQ ID NO: 275 - protein, 117 aa, Mus musculus
QVQLKESGPGLVAPSQSLSITCTVSGFSLTNYGVHWVRQPPGKGLEWLGVIWAGGITNYNSALMSRLSISEDNSKSQVFLKMNSLQTDDTAMYYCARNLGPYAMDYWGQGTSVTVSS

SEQ ID NO: 276 - DNA, 333 bp, Mus musculus
  misc_feature (1)..(333): SC16.118 VL
  CDS (1)..(333)
gacattgtgctgacccaatctccagcttctttggctgtgtctctagggcagagggccaccatctcctgcaaggccagccaaagtgttgattatgatggtgatagttatttgacctggtaccaacagaaaccaggacagccacccaaactcctcatctatgctgcatccaatctagaatctgggatcccagccaggtttagtggcagtgggtctgggacagacttcaccctcaacatccatcctgtggaggaggaggacgctgcaacctattactgtcagcaaagtaatgaggatccgtacacgttcggaggggggaccaagctggaaataaaa

SEQ ID NO: 277 - protein, 111 aa, Mus musculus
DIVLTQSPASLAVSLGQRATISCKASQSVDYDGDSYLTWYQQKPGQPPKLLIYAASNLESGIPARFSGSGSGTDFTLNIHPVEEEDAATYYCQQSNEDPYTFGGGTKLEIK

SEQ ID NO: 278 - DNA, 351 bp, Mus musculus
  misc_feature (1)..(351): SC16.118 VH
  CDS (1)..(351)
gaggtccagctgcagcagtctggacctgacctggtgaagcctggggcttcagtgaagatatcctgcaaggcttctggttactcattcactggctactacatgcactgggtgaagcagagccatggaaagagccttgagtggattggacgtgttaatcctaacaatggtggtactagctacaaccagaagttcaagggcaaggccatattaactgcagacaagtcatccagcacagcctacatggagctccgcagcctgacatctgaggactctgcggtctattactgtgcaagagggagttatgattacgccgagggctggggccaagggactctggtcactgtctctgca

SEQ ID NO: 279 - protein, 117 aa, Mus musculus
EVQLQQSGPDLVKPGASVKISCKASGYSFTGYYMHWVKQSHGKSLEWIGRVNPNNGGTSYNQKFKGKAILTADKSSSTAYMELRSLTSEDSAVYYCARGSYDYAEGWGQGTLVTVSA

SEQ ID NO: 280 - DNA, 339 bp, Mus musculus
  misc_feature (1)..(339): SC16.120 VL
  CDS (1)..(339)
gacattgtgatgtcacagtctccatcctccctagctgtgtcagttggagagaaggttactatgagctgcaagtccagtcagagccttttatatagtagcactcaaaagaactacttggcctggtaccagcagaaaccagggcagtctcctaaactgctgatttactgggcatccactagggaatctggggtccctgatcgcttcacaggcagtggatctgggacagatttcactctcaccatcagcagtgtgaaggctgaagacctggcagtttattactgtcagcaatattatagctatccgtacacgttcggaggggggaccaagctggaaataaaa

SEQ ID NO: 281 - protein, 113 aa, Mus musculus
DIVMSQSPSSLAVSVGEKVTMSCKSSQSLLYSSTQKNYLAWYQQKPGQSPKLLIYWASTRESGVPDRFTGSGSGTDFTLTISSVKAEDLAVYYCQQYYSYPYTFGGGTKLEIK

SEQ ID NO: 282 - DNA, 351 bp, Mus musculus
  misc_feature (1)..(351): SC16.120 VH
  CDS (1)..(351)
gagatccagctgcagcagtctggacctgagctggtgaagcctggggcttcagtgaaggtatcctgcaaggcttctggttatgcattcactagctacaacatgtactgggtgatgcagagccatggaaagagccttgagtggattggatatgttgatccttacaatggtggtactagctacaaccagaagttcaagggcaaggccacattgactgttgacaagtcctccagcacagcctacatgcatctcaacagcctgacatctgaggactctgcagtctattactgtgcaagagaaaactataggtactttgactactggggccaaggcaccactctcacagtctcctca

SEQ ID NO: 283 - protein, 117 aa, Mus musculus
EIQLQQSGPELVKPGASVKVSCKASGYAFTSYNMYWVMQSHGKSLEWIGYVDPYNGGTSYNQKFKGKATLTVDKSSSTAYMHLNSLTSEDSAVYYCARENYRYFDYWGQGTTLTVSS

SEQ ID NO: 284 - DNA, 318 bp, Mus musculus
  misc_feature (1)..(318): SC16.121 VL
  CDS (1)..(318)
caaattgttctcacccagtctccagcaatcatgtctgcatctccaggggagaaggtcaccataacctgcagtgccagctcaagtgtaagttacatgcactggttccagcagaagccaggcacttctcccaaactctggatttatagcacatccaacctggcttctggagtccctgctcgcttcagtggcagtggatctgggacctcttactctctcacaatcagccgaatggaggctgaagatgctgccacttattactgccagcaaaggagtagttacccacccacgttcggaggggggaccaagctggaaataaar

SEQ ID NO: 285 - protein, 106 aa, Mus musculus
QIVLTQSPAIMSASPGEKVTITCSASSSVSYMHWFQQKPGTSPKLWIYSTSNLASGVPARFSGSGSGTSYSLTISRMEAEDAATYYCQQRSSYPPTFGGGTKLEIK

SEQ ID NO: 286 - DNA, 372 bp, Mus musculus
  misc_feature (1)..(372): SC16.121 VH
  CDS (1)..(372)
gaggtgcagcttgttgagtctggtggaggattggtgcagcctaaagggtcattgaaactctcatgtgcagcctctggattcaccttcaatacctacgccatgaactgggtccgccaggctccaggaaagggtttggaatgggttgctcgcataagaattaaaagtaataattatgcaacatattatgccgattcagtaaaagacaggttcaccatctccagagatgattcacaaaacatgctctatctgcaaatgaacaacttgaaaactgaggacacagccgtgtattactgtgtgagacaaggctatagttacgactggggaccctggtttgcttactggggccaagggactctggtcactgtctctgca

SEQ ID NO: 287 - protein, 124 aa, Mus musculus
EVQLVESGGGLVQPKGSLKLSCAASGFTFNTYAMNWVRQAPGKGLEWVARIRIKSNNYATYYADSVKDRFTISRDDSQNMLYLQMNNLKTEDTAVYYCVRQGYSYDWGPWFAYWGQGTLVTVSA

SEQ ID NO: 288 - DNA, 321 bp, Mus musculus
  misc_feature (1)..(321): SC16.122 VL
  CDS (1)..(321)
gacattgtgatgacccagtctcaaaaattcatgtccacatcagtaggagacagggtcagcgtcacctgcaaggccagtcagaatgtgggtactaatgtagcctggtatcaacagaaaccagggcaatctcctaaagtactgatttactcggcatcctaccggtacagtggagtccctgatcgcttcacaggcagtggatctgggacagatttcactctcaccatcagcaatgtgcagtctgaagacttggcagagtttttctgtcagcaatataacagctatcctctgacgttcggtggaggcaccaagctggaaatcaaa

SEQ ID NO: 289 - protein, 107 aa, Mus musculus
DIVMTQSQKFMSTSVGDRVSVTCKASQNVGTNVAWYQQKPGQSPKVLIYSASYRYSGVPDRFTGSGSGTDFTLTISNVQSEDLAEFFCQQYNSYPLTFGGGTKLEIK

SEQ ID NO: 290 - DNA, 354 bp, Mus musculus
  misc_feature (1)..(354): SC16.122 VH
  CDS (1)..(354)
gaagtgcagctggtggagtctgggggaggcttagtgaagcctggagggtccctgaaactctcctgtgcagcctctggattcactttcagtgactattacatgttttgggttcgccagactccggaaaagaggctggagtgggtcgcaaccattagtgatggtggtagttacacctactttccagacagtgtgaaggggcgattcaccatctccagagacaatgcccagaacaacctgtacctgcaaatgagcagtctgaagtctgaggacacagccatgtattactgtgcaagagccgggaccctctatgctatggactactggggtcaaggaacctcagtcaccgtctcctca

SEQ ID NO: 291 - protein, 118 aa, Mus musculus
EVQLVESGGGLVKPGGSLKLSCAASGFTFSDYYMFWVRQTPEKRLEWVATISDGGSYTYFPDSVKGRFTISRDNAQNNLYLQMSSLKSEDTAMYYCARAGTLYAMDYWGQGTSVTVSS

SEQ ID NO: 292 - DNA, 324 bp, Mus musculus
  misc_feature (1)..(324): SC16.123 VL
  CDS (1)..(324)
caaattgttctcacccagtctccagcaatcatgtctgcatctctaggggaacgggtcaccatgacctgcactgccagctcaagtgtaagttccagttacttgcactggtaccagcagaagccaggatcctcccccaaactctggatttatagcacatccaacctggcttctggagtcccagctcgcttcagtggcagtgggtctgggacctcttactctctcacaatcagcagcatggagactgaagatgctgccacttattactgccaccagtatcatcgttcccccttcacgttcggctcggggacaaagttggaaataaaa

SEQ ID NO: 293 - protein, 108 aa, Mus musculus
QIVLTQSPAIMSASLGERVTMTCTASSSVSSSYLHWYQQKPGSSPKLWIYSTSNLASGVPARFSGSGSGTSYSLTISSMETEDAATYYCHQYHRSPFTFGSGTKLEIK

SEQ ID NO: 294 - DNA, 366 bp, Mus musculus
  misc_feature (1)..(366): SC16.123 VH
  CDS (1)..(366)
caggttgctctgaaagagtctggccctgggatattgcagccctcccagaccctcagtctgacttgttctttctctgggttttcactgagcacttctggtatgggtgtaggctggattcgtcagccatcagggaagggtctggagtggctggcacacatttggtgggatgatgtcaagcgctataacccagccctgaagagccgactgactatctccaaggatacctccagcagccaggtattcctcaagatcgccagtgtggacactgcagatactgccacatactactgtgctcgaatggaggactacggtagtagctcctactttgacttctggggccacggcaccactctcacagtctcctca

SEQ ID NO: 295 - protein, 122 aa, Mus musculus
QVALKESGPGILQPSQTLSLTCSFSGFSLSTSGMGVGWIRQPSGKGLEWLAHIWWDDVKRYNPALKSRLTISKDTSSSQVFLKIASVDTADTATYYCARMEDYGSSSYFDFWGHGTTLTVSS

SEQ ID NO: 296 - DNA, 321 bp, Mus musculus
  misc_feature (1)..(321): SC16.124 VL
  CDS (1)..(321)
gacattcagatgacccagtctcctgcctcccagtctgcatctctgggagaaagtgtcaccatcacatgcctggcaagtcagaccattggtacatggttagcatggtatcagcagaaaccagggaaatctcctcagctcctgatttctgctgcaaccagcttggcagatggggtcccatcaaggttcagtggtagtggatctggcacaaaattttctttcaagatcagcagcctacaggctgaagattttgtaagttattactgtcaacaactttacagtactccgtggacgttcggtggaggcaccaagctggaaatcaaa

SEQ ID NO: 297 - protein, 107 aa, Mus musculus
DIQMTQSPASQSASLGESVTITCLASQTIGTWLAWYQQKPGKSPQLLISAATSLADGVPSRFSGSGSGTKFSFKISSLQAEDFVSYYCQQLYSTPWTFGGGTKLEIK

SEQ ID NO: 298 - DNA, 369 bp, Mus musculus
  misc_feature (1)..(369): SC16.124 VH
  CDS (1)..(369)
gaggtccagctgcagcagtctggacctgagctggtaaagcctggggcttcagtgaagatgtcctgcaaggcttctggatacacattcactagctatgttatgcactgggtgaagcagaagcctgggcagggccttgagtggattggatatattaatccttacaatgatggtactaagtacaatgagaagttcaaaggcaaggccacactgacttcagacaaatcctccagcacagcctacatggagctcagcagcctgacctctgaggactctgcggtctattactgtgcaagaggggctctctactatggtaactacctcgggtacttcgatgtctggggcgcagggaccacggtcaccgtctcctca

SEQ ID NO: 299 - protein, 123 aa, Mus musculus
EVQLQQSGPELVKPGASVKMSCKASGYTFTSYVMHWVKQKPGQGLEWIGYINPYNDGTKYNEKFKGKATLTSDKSSSTAYMELSSLTSEDSAVYYCARGALYYGNYLGYFDVWGAGTTVTVSS

SEQ ID NO: 300 - DNA, 321 bp, Mus musculus
  misc_feature (1)..(321): SC16.125 VL
  CDS (1)..(321)
gacatccagatgaaccagtctccatccagtctgtctgcatcccttggagacacaattaccatcacttgccatgccagtcagaacattaatgtttggttaagctggtaccagcagaaaccaggaaatattcctaaactattgatctataaggcttccatcttacacacaggcgtcccatcaaggtttagtggcagtggatctggaacaggtttcacattaaccatcagcagcctgcagcctgaagacattgccacttactcctgtcaacagggtcaaagttatccgtacacgttcggaggggggaccaagctggaaataaaa

SEQ ID NO: 301 - protein, 107 aa, Mus musculus
DIQMNQSPSSLSASLGDTITITCHASQNINVWLSWYQQKPGNIPKLLIYKASILHTGVPSRFSGSGSGTGFTLTISSLQPEDIATYSCQQGQSYPYTFGGGTKLEIK

SEQ ID NO: 302 - DNA, 354 bp, Mus musculus
  misc_feature (1)..(354): SC16.125 VH
  misc_feature (354)..(354): The 'n' at position 354 may be a or g or c or t
  CDS (1)..(354)
gatgtgcagcttcaggagtcaggacctgacctggtgaaaccttctcagtcactttcactcacctgcactgtcactggctactccatcaccagtggttatagctggcactggatccggcagtttccaggaaacaaactggaatggatgggctacatacactacagtggtagcactaactacaacccatctctcaaaagtcgaatctctatcactcgagacacatccaagaaccagttcttcctgcagttcaaatctgtgactactgaagactcagccacatattactgtgccctagaggggaattacgacgggtttgcttactggggccaagggactctggtcactgtctcttcn

SEQ ID NO: 303 - protein, 118 aa, Mus musculus
  misc_feature (118)..(118): The 'Xaa' at location 118 stands for Ser.
DVQLQESGPDLVKPSQSLSLTCTVTGYSITSGYSWHWIRQFPGNKLEWMGYIHYSGSTNYNPSLKSRISITRDTSKNQFFLQFKSVTTEDSATYYCALEGNYDGFAYWGQGTLVTVSX

SEQ ID NO: 304 - DNA, 321 bp, Mus musculus
  misc_feature (1)..(321): SC16.126 VL
  CDS (1)..(321)
gacatccagatgaaccagtctccatccagtctgtctgcatcccttggagacacaattaccatcacttgccatgccagtcagaacataaatgtttggttaagctggtaccagcagaaaccaggaaatattcctaaactattgatctataaggcttccaacttgcacacaggcgtcccatcaaggtttagtggcagtggatctggaacaggtttcacattaaccatcagcagcctgcagcctgaagacattgccacttactactgtcaacagggtcaaagttatccattcacgttcggctcggggacaaagttggaaataaaa

SEQ ID NO: 305 - protein, 107 aa, Mus musculus
DIQMNQSPSSLSASLGDTITITCHASQNINVWLSWYQQKPGNIPKLLIYKASNLHTGVPSRFSGSGSGTGFTLTISSLQPEDIATYYCQQGQSYPFTFGSGTKLEIK

SEQ ID NO: 306 - DNA, 348 bp, Mus musculus
  misc_feature (1)..(348): SC16.126 VH
  CDS (1)..(348)
caggtgcagatgaaggagtcaggacctggcctggtggcgccctcacagagcctgtccatcacttgcactgtctctgggtcttcattaaccaactatggtgtacactgggttcgccagcctccaggaaagggtctagagtggctgggagtaatatgggctggtggaagcacaaattataattcggctctcatgtccagactgagtatcagcaaagacaactccaagagccaagttttcttaaaaatgaacagtctgcaaactgatgacacagccatgtactactgtgccagagactgggagggctggtttgcttactggggccaagggactctggtcactgtctctgca

SEQ ID NO: 307 - protein, 116 aa, Mus musculus
QVQMKESGPGLVAPSQSLSITCTVSGSSLTNYGVHWVRQPPGKGLEWLGVIWAGGSTNYNSALMSRLSISKDNSKSQVFLKMNSLQTDDTAMYYCARDWEGWFAYWGQGTLVTVSA

SEQ ID NO: 308 - DNA, 321 bp, Mus musculus
  misc_feature (1)..(321): SC16.129 VL
  CDS (1)..(321)
gacattcagatgacccagtctcctgcctcccagtctgcatctctgggagaaagtgtcaccatcacatgcctggcaagtcagaccattggtacatggttagcatggtatcagcagaaaccagggaaatctcctcagctcctgatttatgctgcaaccagcttggcagatggggtcccatcaaggttcagtggtagtggatctggcacaaaattttctttcaagatcagcagcctacaggctgaagattttgtaagttattactgtcaacaactttacagtactccgtacacgttcggaggggggaccaagctggaaataaaa

SEQ ID NO: 309 - protein, 107 aa, Mus musculus
DIQMTQSPASQSASLGESVTITCLASQTIGTWLAWYQQKPGKSPQLLIYAATSLADGVPSRFSGSGSGTKFSFKISSLQAEDFVSYYCQQLYSTPYTFGGGTKLEIK

SEQ ID NO: 310 - DNA, 348 bp, Mus musculus
  misc_feature (1)..(348): SC16.129 VH
  CDS (1)..(348)
caggtgcagctaaaggagtcaggacctggcctggtggcgccctcacagagcctgtccatcacatgcactgtctcagggttctcattaaccgactatggtgtaagctggattcgccagcctccaggaaagggtctggagtggctgggagtaatatggggtggtggaagcacatactataattcagctctcaaatccagactgagcatcagcaaggacaactccaagagccaagttttcttagaactgaacagtctgcaaactgatgacacagccatttactactgtgccaaacattatggtcactacgctgcttactggggccaagggactctggtcactgtctctgca

SEQ ID NO: 311 - protein, 116 aa, Mus musculus
QVQLKESGPGLVAPSQSLSITCTVSGFSLTDYGVSWIRQPPGKGLEWLGVIWGGGSTYYNSALKSRLSISKDNSKSQVFLELNSLQTDDTAIYYCAKHYGHYAAYWGQGTLVTVSA

SEQ ID NO: 312 - DNA, 321 bp, Mus musculus
  misc_feature (1)..(321): SC16.130 VL
  CDS (1)..(321)
gacatccagttgactcagtctccagcctccctatctgcatctgtgggagaaactgtcaccatcacatgtcgagcaagtgggagtattcacaattatttagcatggtatcagcagaaacagggaaagtctcctcagctcctggtctataatgcaaaaaccttagtagatggtgtgccatcaaggttcagtggcagtggatcaggaacacaatattctctcaagatcaacagcctgcagcctgaagattttgggtattattactgtcaacatttttggactactccgtggacattcggtggaggcaccaagctggaaatcaaa

SEQ ID NO: 313 - protein, 107 aa, Mus musculus
DIQLTQSPASLSASVGETVTITCRASGSIHNYLAWYQQKQGKSPQLLVYNAKTLVDGVPSRFSGSGSGTQYSLKINSLQPEDFGYYYCQHFWTTPWTFGGGTKLEIK

SEQ ID NO: 314 - DNA, 360 bp, Mus musculus
  misc_feature (1)..(360): SC16.130 VH
  CDS (1)..(360)
gaggtccagctgcagcagtctggacctgagctggtaaagcctggggcttcagtgaagatgtcctgcaaggcttctggatacacattcactagctatgttatgcactgggtgaagcagaagcctgggcagggccttgagtggattggatatattaatccttacaatgatggtactgagtacaatgagaagttcaaaggcaaggccacactgacttcagacaaatcctccagcacagcctacatggagctcagcagcctgacctctgaggactctgcggtctattactgtgcaagaggggtctatgatggttactcttactttgactactggggccaaggcaccactctcacagtctcctca

SEQ ID NO: 315 - protein, 120 aa, Mus musculus
EVQLQQSGPELVKPGASVKMSCKASGYTFTSYVMHWVKQKPGQGLEWIGYINPYNDGTEYNEKFKGKATLTSDKSSSTAYMELSSLTSEDSAVYYCARGVYDGYSYFDYWGQGTTLTVSS

SEQ ID NO: 316 - DNA, 321 bp, Mus musculus; identical to SEQ ID NO: 272
  misc_feature (1)..(321): SC16.131 VL
  CDS (1)..(321)

SEQ ID NO: 317 - protein, 107 aa, Mus musculus; identical to SEQ ID NO: 273

SEQ ID NO: 318 - DNA, 351 bp, Mus musculus; identical to SEQ ID NO: 274
  misc_feature (1)..(351): SC16.131 VH
  CDS (1)..(351)

SEQ ID NO: 319 - protein, 117 aa, Mus musculus; identical to SEQ ID NO: 275

SEQ ID NO: 320 - DNA, 321 bp, Mus musculus
  misc_feature (1)..(321): SC16.132 VL
  CDS (1)..(321)
gacattcagatgacccagtctcctgcctcccagtctgcatctctgggagaaagtgtcaccatcacatgcctggcaagtcagaccattggtacatggttagcatggtatcagcagaaaccagggaaatctcctcagctcctgatttatgctgcaaccagcttggcagatggggtcccatcaaggttcagtggtagtggatctggcacaaaattttctttcaagatcagcagcctacaggctgaagattttgtaagttattactgtcaacaactttacagtactccgtggacgttcggtggaggcaccaagctggagatcaaa

SEQ ID NO: 321 - protein, 107 aa, Mus musculus
DIQMTQSPASQSASLGESVTITCLASQTIGTWLAWYQQKPGKSPQLLIYAATSLADGVPSRFSGSGSGTKFSFKISSLQAEDFVSYYCQQLYSTPWTFGGGTKLEIK

SEQ ID NO: 322 - DNA, 348 bp, Mus musculus
  misc_feature (1)..(348): SC16.132 VH
  CDS (1)..(348)
caggtgcagctgaaggagtcaggacctggcctggtggcgccctcacagagcctgtccatcacatgcactgtctcagggttctcattaaccgactatggtgtaagctggattcgccagcctccaggaaagggtctggagtggctgggagtagtatggggtggtggaagcacatactataattccgctctcaaatccagactgagcatcaccaaggacaactccaagagccaagttttcttaaaaatgaacagtctgcaaactgatgacacagccatgtactactgtgccaaacagaggggtcagtacggggcttactggggccaagggactctggtcactgtctctgca

SEQ ID NO: 323 - protein, 116 aa, Mus musculus
QVQLKESGPGLVAPSQSLSITCTVSGFSLTDYGVSWIRQPPGKGLEWLGVVWGGGSTYYNSALKSRLSITKDNSKSQVFLKMNSLQTDDTAMYYCAKQRGQYGAYWGQGTLVTVSA

SEQ ID NO: 324 - DNA, 321 bp, Mus musculus
  misc_feature (1)..(321): SC16.133 VL
  CDS (1)..(321)
agtattgtgatgacccagactcccaaattcctgcttgtttcagcaggagacagggttaccataacctgcaaggccagtcagagtgtgagtaatgatgtagcttggtaccaacagaagccagggcagtctcctaaactgctgatatactgtgcatccaatcgctacactggagtccctgatcgcttcactggcagtggatatgggacggatttcactttcaccatcagcactgtgcaggctgaagacctggcagtttatttctgtcagcaggattatagctctccgctcacgttcggtgctgggaccaagctggagctgaaa

SEQ ID NO: 325 - protein, 107 aa, Mus musculus
SIVMTQTPKFLLVSAGDRVTITCKASQSVSNDVAWYQQKPGQSPKLLIYCASNRYTGVPDRFTGSGYGTDFTFTISTVQAEDLAVYFCQQDYSSPLTFGAGTKLELK

SEQ ID NO: 326 - DNA, 357 bp, Mus musculus
  misc_feature (1)..(357): SC16.133 VH
  CDS (1)..(357)
caggtgcagctgaaggagtcaggacctggcctggtggcgccctcacagagcctgtccatcacctgcacagtctctggtttctcattaaccaactatgctgtacactgggttcgccagtctccaggaaagggtctggagtggctgggagtgatatggagtgatggaagcacagactataatgcagctttcatatctagactgagcatcagcaaggacaactccaagagccaagttttctttaagatgaacagtctgcaagctgatgacacagccatgtactactgtgcccgaaagaaaggaggatggtttccctggtttgcttactggggccaagggactctggtcactgtctctgca

SEQ ID NO: 327 - protein, 119 aa, Mus musculus
QVQLKESGPGLVAPSQSLSITCTVSGFSLTNYAVHWVRQSPGKGLEWLGVIWSDGSTDYNAAFISRLSISKDNSKSQVFFKMNSLQADDTAMYYCARKKGGWFPWFAYWGQGTLVTVSA

SEQ ID NO: 328 - DNA, 333 bp, Mus musculus
  misc_feature (1)..(333): SC16.134 VL
  CDS (1)..(333)
gacattgtgctgacccaatctccagcttctttggctgtgtctctagggcagagggccaccatctcctgcaaggccagccaaagtgttgatcatgctggtgatagttatatgaactggtaccaacagaaaccaggacagccacccaaactcctcatctatgctgcatccaatctagaatctgggatcccagccaggtttagtggcagtgggtctgggacagacttcaccctcaacatccatcctgtggaggaggaggatgctgcaacctattactgtcagcaaagtaatgaggatccgtacacgttcggaggggggaccaagctggaaatcaaa

SEQ ID NO: 329 - protein, 111 aa, Mus musculus
DIVLTQSPASLAVSLGQRATISCKASQSVDHAGDSYMNWYQQKPGQPPKLLIYAASNLESGIPARFSGSGSGTDFTLNIHPVEEEDAATYYCQQSNEDPYTFGGGTKLEIK

SEQ ID NO: 330 - DNA, 351 bp, Mus musculus
  misc_feature (1)..(351): SC16.134 VH
  CDS (1)..(351)
gaggtccagctgcagcagtctggacctgacctggtgaagcctggggcttcagtgaagatatcctgcaaggcttctggttactcattcactggctactacatgcactgggtgaagcagagccatggaaagaggcttgagtggattggacgtgttaatcctaacaatggtggtactaactacaaccagaaattcaagggcaaggccatattaactgtagacaagtcatccagcacagcctacatggagctccgcagcctgacatctgaggactctgcggtctattactgtgcaagagggagttatgataacgccgagggctggggccaagggactctggtcactgtctctgca

SEQ ID NO: 331 - protein, 117 aa, Mus musculus
EVQLQQSGPDLVKPGASVKISCKASGYSFTGYYMHWVKQSHGKRLEWIGRVNPNNGGTNYNQKFKGKAILTVDKSSSTAYMELRSLTSEDSAVYYCARGSYDNAEGWGQGTLVTVSA

SEQ ID NO: 332 - DNA, 321 bp, Mus musculus
  misc_feature (1)..(321): SC16.135 VL
  CDS (1)..(321)
gacatcaagatgacccagtctccatcttccatgtatgcatctctaggagagagagtcactatcacttgcaaggcgagtcaggacattaataggtatttaagctggttccagcagaaaccagggaaatctcctaagaccctgatctatcgtgcaaacagattggtagatggggtcccatcaaggttcagtggcagtggatctgggcaagattattctctcaccatcagcagcctggagtatgaagatatgggaatttattattgtctacagtatgatgagtttccattcacgttcggctcggggacaaagttggaaataaaa

SEQ ID NO: 333 - protein, 107 aa, Mus musculus
DIKMTQSPSSMYASLGERVTITCKASQDINRYLSWFQQKPGKSPKTLIYRANRLVDGVPSRFSGSGSGQDYSLTISSLEYEDMGIYYCLQYDEFPFTFGSGTKLEIK

SEQ ID NO: 334 - DNA, 363 bp, Mus musculus
  misc_feature (1)..(363): SC16.135 VH
  CDS (1)..(363)
caggtccagttgcagcagtctggagctgagctggtaaggcctgggacttcagtgaaggtgtcctgcaaggcttctggatacgccttcactaattacttgatagagtgggtaaagcagaggcctggacagggccttgagtggattggggtgattaatcctggaagtggtggtactaactccaatgagaagttcaaggccaaggcaacactgactgcagacaaatcctccagcactgcctacatgcagctcagcagcctgacatctgctgactctgcggtctatttctgtgcaagatcggactatgattacgccttctatgctatggactactggggtcaaggaacctcagtcaccgtctcctca

SEQ ID NO: 335 - protein, 121 aa, Mus musculus
QVQLQQSGAELVRPGTSVKVSCKASGYAFTNYLIEWVKQRPGQGLEWIGVINPGSGGTNSNEKFKAKATLTADKSSSTAYMQLSSLTSADSAVYFCARSDYDYAFYAMDYWGQGTSVTVSS

SEQ ID NO: 336 - DNA, 321 bp, Mus musculus
  misc_feature (1)..(321): SC16.136 VL
  CDS (1)..(321)
gacatccagatgactcagtctccagcctccctatctgcatctgtgggagaaactgtcaccatcacatgtcgagcaagtgggaatattcacaattatttagcatggtatcagcagaaacagggaaaatctcctcacctcctggtctataatgcaaaaaccttagcagatggtgtgccatcaaggttcagtggcagtggatcaggaacacaatattctctcaagatcaacagcctgcagcctgaagattttgggagttattactgtcaacatttttggagtactccgtggacgttcggtggaggcaccaagctggaaatcaaa

SEQ ID NO: 337 - protein, 107 aa, Mus musculus
DIQMTQSPASLSASVGETVTITCRASGNIHNYLAWYQQKQGKSPHLLVYNAKTLADGVPSRFSGSGSGTQYSLKINSLQPEDFGSYYCQHFWSTPWTFGGGTKLEIK

SEQ ID NO: 338 - DNA, 366 bp, Mus musculus
  misc_feature (1)..(366): SC16.136 VH
  CDS (1)..(366)
gaggtccagctgcagcagtctggacctgagctggtaaagcctggggcttcagtgaagatgtcctgcaaggcttctggatacacattcactagctatgttatgcactgggtgaagcagaagcctgggcagggccttgagtggattggatatattaatccttacaatgatggtactaagtacaatgagaagttcaaaggcaaggccacactgacttcagacaaatcctccagcacagcctacatggagctcagcagcctgacctctgaggactctgcggtctattactgtgcaagagacaggtcgggctacgaagattactatggtatggactactggggtcaaggaacctcagtcaccgtctcctca

SEQ ID NO: 339 - protein, 122 aa, Mus musculus
EVQLQQSGPELVKPGASVKMSCKASGYTFTSYVMHWVKQKPGQGLEWIGYINPYNDGTKYNEKFKGKATLTSDKSSSTAYMELSSLTSEDSAVYYCARDRSGYEDYYGMDYWGQGTSVTVSS

SEQ ID NO: 340 - DNA, 318 bp, Mus musculus
  misc_feature (1)..(318): SC16.137 VL
  CDS (1)..(318)
caaattgttctcacccagtctccagcaatcatgtctgcatctctaggggaggagatcaccctaacctgcagtgccagctcgagtgtaagttacatgcactggtaccagcagaagtcaggcacttctcccaaactcttgatttatagcacatccaacctggcttctggagtcccttctcgcttcagtggcagtgggtctgggaccttttattctctcacaatcagcagtgtggaggctgaagatgctgccgattattactgccatcagtggagtagttatcacacgttcggaggggggaccaagctggaaataaaacgg

SEQ ID NO: 341 - protein, 106 aa, Mus musculus
QIVLTQSPAIMSASLGEEITLTCSASSSVSYMHWYQQKSGTSPKLLIYSTSNLASGVPSRFSGSGSGTFYSLTISSVEAEDAADYYCHQWSSYHTFGGGTKLEIKR

SEQ ID NO: 342 - DNA, 351 bp, Mus musculus
  misc_feature (1)..(351): SC16.137 VH
  CDS (1)..(351)
gaggtgcagctggtggagtctgggggagacttagtgaagcctggagggtccctgaaactctcctgtgcagcctctggattcactttcagtagctatggcatgtcttgggttcgccagactccagacaagaggctggagtgggtcgcaaccattagtagtggtggtagttacacctactatccagacagtgtgaaggggcgattcaccatctccagagacaatgccaagaacaccctgtacctgcaaatgagcagtctgaagtctgaggacacagccatgtattactgtgcaagacgaagagccgatgctatggactactggggtcaaggaacctcagtcaccgtctcctca

SEQ ID NO: 343 - protein, 117 aa, Mus musculus
EVQLVESGGDLVKPGGSLKLSCAASGFTFSSYGMSWVRQTPDKRLEWVATISSGGSYTYYPDSVKGRFTISRDNAKNTLYLQMSSLKSEDTAMYYCARRRADAMDYWGQGTSVTVSS

SEQ ID NO: 344 - DNA, 321 bp, Mus musculus
  misc_feature (1)..(321): SC16.138 VL
  CDS (1)..(321)
gacattcagatgacccagtctcctgcctcccagtctgcatctctgggagaaagtgtcaccatcacatgcctggcaagtcagaccattggtacatggttagcatggtatcagcagaaaccagggaaatctcctcagctcctgatttattctgcaaccagcttggcagatggggtcccatcaaggttcagtggtagtggatctggcacaaaattttctttcaagatcagcagcctacaggctgaagattttgtaagttattactgtcaacaactttacagtactccgtggacgttcggtggaggcaccaagctggaaatcaaa

SEQ ID NO: 345 - protein, 107 aa, Mus musculus
DIQMTQSPASQSASLGESVTITCLASQTIGTWLAWYQQKPGKSPQLLIYSATSLADGVPSRFSGSGSGTKFSFKISSLQAEDFVSYYCQQLYSTPWTFGGGTKLEIK

SEQ ID NO: 346 - DNA, 348 bp, Mus musculus
  misc_feature (1)..(348): SC16.138 VH
  CDS (1)..(348)
caggtgcagctgaaggagtcaggacctggcctggtggcgccctcacagagcctgtccatcacatgcactgtctcagggttctcattaaccgactatggtgtaagctggattcgccagcctccaggaaagggtctggagtggctgggagtagtatggggtggtggaagcacatactataattccgctctcaaatccagactgagcatcagcaaggacaactccaagagccaagttttcttaaaaatgaacagtctgcaaactgatgacacagccatgtactactgtgccaaacagaggggtcagtacggggcttactggggccaagggactctggtcactgtctctgca

SEQ ID NO: 347 - protein, 116 aa, Mus musculus
QVQLKESGPGLVAPSQSLSITCTVSGFSLTDYGVSWIRQPPGKGLEWLGVVWGGGSTYYNSALKSRLSISKDNSKSQVFLKMNSLQTDDTAMYYCAKQRGQYGAYWGQGTLVTVSA

SEQ ID NO: 348 - DNA, 321 bp, Mus musculus
  misc_feature (1)..(321): SC16.139 VL
  CDS (1)..(321)
gacattgtgatgacccagtctcacaaattcatgtccacatcagtaggagacagggtcagcatcacctgcaaggccagtcaggatgtgaatactgctgtaggctggtatcaacagaaaccaggacaatctcctaaactactgatttactcggcatcctaccggtacactggagtccctgatcgcttcactggcagtggatctgggacggatttcactttcaccatcagcagtgtgcaggctgaagacctggcagtttattactgtcagcaacattatagtagtccgtacacgttcggaggggggaccaagctggaaattaaa

SEQ ID NO: 349 - protein, 107 aa, Mus musculus
DIVMTQSHKFMSTSVGDRVSITCKASQDVNTAVGWYQQKPGQSPKLLIYSASYRYTGVPDRFTGSGSGTDFTFTISSVQAEDLAVYYCQQHYSSPYTFGGGTKLEIK

SEQ ID NO: 350 - DNA, 357 bp, Mus musculus; identical to SEQ ID NO: 238
  misc_feature (1)..(357): SC16.139 VH
  CDS (1)..(357)

SEQ ID NO: 351 - protein, 119 aa, Mus musculus; identical to SEQ ID NO: 239

SEQ ID NO: 352 - DNA, 333 bp, Mus musculus
  misc_feature (1)..(333): SC16.140 VL
  CDS (1)..(333)
gacattgtgctgacacagtctcttgcttccttagctgtatctctggggcagagggccaccatctcatgcagggccagcaaaagtgtcagtacatctggctatagttatatgcactggtaccaacagaaaccaggacagccacccaaactcctcatttatcttgcatccaacctagaatctggggtccctgccaggttcagtggcagtgggtctgggacagacttcaccctcaacatccatcctgtggaagacgaagatgctgcaacctattactgtcagcacagtagggagcttccgttcacgttcggaggggggaccaagctggaaataaag

SEQ ID NO: 353 - protein, 111 aa, Mus musculus
DIVLTQSLASLAVSLGQRATISCRASKSVSTSGYSYMHWYQQKPGQPPKLLIYLASNLESGVPARFSGSGSGTDFTLNIHPVEDEDAATYYCQHSRELPFTFGGGTKLEIK

SEQ ID NO: 354 - DNA, 348 bp, Mus musculus
  misc_feature (1)..(348): SC16.140 VH
  CDS (1)..(348)
caggtccaactgcagcagtctgggcctgagctggtgaggcctggggcttcagtgaagatgtcctgcaaggcttcaggctataccttcaccagctactggatgcactgggtgaaacagaggcctggacaaggccttgagtggattggcatgattgatccttccaatagtgaaactaggttaaatcagaagttcaaggacaaggccacattgaatgtagacaaatcctccaacacagcctacatgcagctcagcagcctgacatctgaggactctgcagtctattactgtgcagtaatggactactactttgactactggggccaaggcaccactctcacagtctcctca

SEQ ID NO: 355 - protein, 116 aa, Mus musculus
QVQLQQSGPELVRPGASVKMSCKASGYTFTSYWMHWVKQRPGQGLEWIGMIDPSNSETRLNQKFKDKATLNVDKSSNTAYMQLSSLTSEDSAVYYCAVMDYYFDYWGQGTTLTVSS

SEQ ID NO: 356 - DNA, 321 bp, Mus musculus; identical to SEQ ID NO: 232
  misc_feature (1)..(321): SC16.141 VL
  CDS (1)..(321)

SEQ ID NO: 357 - protein, 107 aa, Mus musculus; identical to SEQ ID NO: 233

SEQ ID NO: 358 - DNA, 345 bp, Mus musculus; identical to SEQ ID NO: 234
  misc_feature (1)..(345): SC16.141 VH
  CDS (1)..(345)

SEQ ID NO: 359 - protein, 115 aa, Mus musculus; identical to SEQ ID NO: 235

SEQ ID NO: 360 - DNA, 321 bp, Mus musculus
  misc_feature (1)..(321): SC16.142 VL
  CDS (1)..(321)
gacatcaagatgacccagtctccatcttccatgtatgcatctctaggagagagagtcactatcacttgcaaggcgagtcaggacattaataattatttaagctggttccagcagaaaccagggaaatctcctaagaccctgatctatcgtgcaaacagattggtagatggggtcccatcaaggttcagtggcagtggatctgggcaagattattctctcaccatcagcagcctggagtatgaagatatgggaatttattattgtctacagtatgatgagtttccgtacacgttcggaggggggaccaagctggaaataaaa

SEQ ID NO: 361 - protein, 107 aa, Mus musculus
DIKMTQSPSSMYASLGERVTITCKASQDINNYLSWFQQKPGKSPKTLIYRANRLVDGVPSRFSGSGSGQDYSLTISSLEYEDMGIYYCLQYDEFPYTFGGGTKLEIK

SEQ ID NO: 362 - DNA, 345 bp, Mus musculus
  misc_feature (1)..(345): SC16.142 VH
  misc_feature (336)..(336): The 'v' at position 336 may be a or g or c
  misc_feature (339)..(339): The 'n' at position 339 may be a or g or c or t
  misc_feature (342)..(342): The 'n' at position 342 may be a or g or c or t
  misc_feature (345)..(345): The 'n' at position 345 may be a or g or c or t
  CDS (1)..(345)
gaggtccagcttcagcagtcaggacctgagctggtgaaacctggggcctcagtgaagatatcctgcaaggcttctggatacacattcactgactacaacatgcactgggtgaagcagagccatggaaagagccttgagtggattggattcttttatccttacaacggtaatactgtctacagccagaagttcaagagcaaggccacattgactgtagacaattcctccagcacagcctacatggagctccgcagcctgacatctgaggactctgcagtctattactgtgcaagacttaactgggagggctactggggccaaggcaccaccctcacvgtntcntcn

SEQ ID NO: 363 - protein, 115 aa, Mus musculus
  misc_feature (112)..(112): The 'Xaa' at location 112 stands for Thr.
  misc_feature (114)..(114): The 'Xaa' at location 114 stands for Ser.
  misc_feature (115)..(115): The 'Xaa' at location 115 stands for Ser.
EVQLQQSGPELVKPGASVKISCKASGYTFTDYNMHWVKQSHGKSLEWIGFFYPYNGNTVYSQKFKSKATLTVDNSSSTAYMELRSLTSEDSAVYYCARLNWEGYWGQGTTLXVXX

SEQ ID NO: 364 - DNA, 336 bp, Mus musculus
  misc_feature (1)..(336): SC16.143 VL
  CDS (1)..(336)
gatgttttgatgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacatgttccgctcacgttcggtgctgggaccaagctggagctgaaa

SEQ ID NO: 365 - protein, 112 aa, Mus musculus
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPLTFGAGTKLELK

SEQ ID NO: 366 - DNA, 357 bp, Mus musculus
  misc_feature (1)..(357): SC16.143 VH
  CDS (1)..(357)
caggtccagctgcagcagtctggacctgagctggtgaagcctggggcttcagtgaggatatcctgcaaggcttctggctacaccttcacaagctactatatacactgggtgaagcagaggcctggacagggacttgagtggattggatggatttatcctggaaatggtaatactaagtacaatgagaagttcaagggcaaggccacactgactgcagacaaatcctccagcacagcctacatgcagatcagcagcctgacctctgaggactctgcggtctatttctgtgcaagagagagatggttactactatggtttgcttactggggccaagggactctggtcactgtctctgca

SEQ ID NO: 367 - protein, 119 aa, Mus musculus
QVQLQQSGPELVKPGASVRISCKASGYTFTSYYIHWVKQRPGQGLEWIGWIYPGNGNTKYNEKFKGKATLTADKSSSTAYMQISSLTSEDSAVYFCARERWLLLWFAYWGQGTLVTVSA

SEQ ID NO: 368 - DNA, 321 bp, Mus musculus
  misc_feature (1)..(321): SC16.144 VL
  CDS (1)..(321)
agtattgtgatgacccagactcccaaattcctgcttgtatcagcaggagacagggttaccataacctgcaaggccagtcagagtgtgagtaatgatgtaggttggtaccaacagaagccagggcagtctcctaaactgctgatatactatgcatccaatcgctacaatggagtccctgatcgcttcactggcagtggatatgggacggatttcactttcaccatcagcactgtgcaggctgaagacctggcagtttatttctgtcagcaggattatagctctccgtggacgttcggtggaggcaccaagctggaaatcaaa

SEQ ID NO: 369 - protein, 107 aa, Mus musculus
SIVMTQTPKFLLVSAGDRVTITCKASQSVSNDVGWYQQKPGQSPKLLIYYASNRYNGVPDRFTGSGYGTDFTFTISTVQAEDLAVYFCQQDYSSPWTFGGGTKLEIK

SEQ ID NO: 370 - DNA, 354 bp, Mus musculus
  misc_feature (1)..(354): SC16.144 VH
  CDS (1)..(354)
cagatccagttggtgcagtctggacctgagctgaagaagcctggagagacagtcaagatctcctgcaaggcttctgggtataccttcacaaactatggaatgaactgggtgaagcaggctccaggaaagggtttaaagtgggtgggctggataaacacctacactggagagccaacatatgctgatgacttcaagggacggtttgccttctctttggaaacctctgccagcactgcctatttgcagatcgacaacctcaaaaatgaggacacggctacatatttctgtgcaagagtgggggattacgtcggctttgactactggggccaaggcaccactctcacagtctcctca

SEQ ID NO: 371 - protein, 118 aa, Mus musculus
QIQLVQSGPELKKPGETVKISCKASGYTFTNYGMNWVKQAPGKGLKWVGWINTYTGEPTYADDFKGRFAFSLETSASTAYLQIDNLKNEDTATYFCARVGDYVGFDYWGQGTTLTVSS

SEQ ID NO: 372 - DNA, 321 bp, Mus musculus
  misc_feature (1)..(321): SC16.147 VL
  CDS (1)..(321)
gatatccagatgacacagactgcatcctccctgtctgcctctctgggagacagagtcaccatcagttgcagggcaagtcaggacattaacaattatttaaactggtatcagcagaaaccagatggaactgttaaactcctgatctactacacatcaagattacactcaggagtcccatcaaggttcagtggcagtgggtctggaacagattattctctcaccattagcatcctggaacaagaagatattgccacttacttttgccaacagggtgatacgcttccgtggacgttcggtggaggcaccaagctggaaatcaaa

SEQ ID NO: 373 - protein, 107 aa, Mus musculus
DIQMTQTASSLSASLGDRVTISCRASQDINNYLNWYQQKPDGTVKLLIYYTSRLHSGVPSRFSGSGSGTDYSLTISILEQEDIATYFCQQGDTLPWTFGGGTKLEIK

SEQ ID NO: 374 - DNA, 351 bp, Mus musculus
  misc_feature (1)..(351): SC16.147 VH
  CDS (1)..(351)
cagatccagttggtgcagtctggacctgagctgacgaagcctggagagacagtcaagatctcctgcaaggcctctggatataccttcacagactattcattgcactgggtgaagcaggctctaggaaagggtttaaagtggatgggctggataaacactgagactggtgagccagcatatgcagatgacttcaagggacggtttgccttctctttggaaacctctgccagcactgcctatttgcagatcaacgacctcaaaaatgaggacacgactacatatttctgtggtatttacgacgggtatgctatggactactggggtcaaggaacctcagtcaccgtctcctca

SEQ ID NO: 375 - protein, 117 aa, Mus musculus
QIQLVQSGPELTKPGETVKISCKASGYTFTDYSLHWVKQALGKGLKWMGWINTETGEPAYADDFKGRFAFSLETSASTAYLQINDLKNEDTTTYFCGIYDGYAMDYWGQGTSVTVSS

SEQ ID NO: 376 - DNA, 318 bp, Mus musculus
  misc_feature (1)..(318): SC16.148 VL
  CDS (1)..(318)
caaattgttctcacccagtctccagcaatcatgtctgcatctccaggggagaaggtcaccatgacctgcagtgccagctcaagtgtaagttacatgtactggtaccagcagaagccaggatcctcccccagactcctgatttatgacacatccaacctggcttctggagtccctgttcgcttcagtggcagtgggtctgggacctcttactctctcacaatcagccgaatggaggctgaagatactgccacttattattgccaggagtggagtaataatccgctcacgttcggtgatgggaccaagctggagctgaaa

SEQ ID NO: 377 - protein, 106 aa, Mus musculus
QIVLTQSPAIMSASPGEKVTMTCSASSSVSYMYWYQQKPGSSPRLLIYDTSNLASGVPVRFSGSGSGTSYSLTISRMEAEDTATYYCQEWSNNPLTFGDGTKLELK

SEQ ID NO: 378 - DNA, 354 bp, Mus musculus
  misc_feature (1)..(354): SC16.148 VH
  CDS (1)..(354)
cagatccagttggtgcagtctggacctgagctgaagaagcctggagagacagtcaagatctcctgcaaggcttctgggtataccctcacaaactatggaatgaactgggtgaagcaggctccaggaaagggtttaaagtggatgggctggataaacacctacactggagagccaacatatgctgatgacttcaagggacggtttgccttctctttggaaacctctgccaggattgtctatttgcagatcaacaacctcaaaaatgaggacacggctacatatttctgtgcaaaatatgaggcccacgaggggtttgtttattggggccaagggactctggtcactgtctctgca

SEQ ID NO: 379 - protein, 118 aa, Mus musculus
QIQLVQSGPELKKPGETVKISCKASGYTLTNYGMNWVKQAPGKGLKWMGWINTYTGEPTYADDFKGRFAFSLETSARIVYLQINNLKNEDTATYFCAKYEAHEGFVYWGQGTLVTVSA

SEQ ID NO: 380 - DNA, 321 bp, Mus musculus
  misc_feature (1)..(321): SC16.149 VL
  CDS (1)..(321)
gacatccagatgaaccagtctccatccagtctgtctgcatcccttggagacacaattaccatcacttgccatgccagtcagaacattaatgtttggttaagctggtaccagcagaaaccaggaaatattccaaaactattgatctataaggcttcccacttgcacacaggcgtcccatcaaggttgagtggcagtggatctggaacaggtttcacattaaccatcagcagcctgcagcctgaagacattgccacttactactgtcaacagggtcaaagttatccattcacgttcggctcggggacaacgttggaaataaaa

SEQ ID NO: 381 - protein, 107 aa, Mus musculus
DIQMNQSPSSLSASLGDTITITCHASQNINVWLSWYQQKPGNIPKLLIYKASHLHTGVPSRLSGSGSGTGFTLTISSLQPEDIATYYCQQGQSYPFTFGSGTTLEIK

SEQ ID NO: 382 - DNA, 348 bp, Mus musculus
  misc_feature (1)..(348): SC16.149 VH
  CDS (1)..(348)
caggtgcagctgaaggagtcaggacctggcctggtggcgccctcacagagcctgtccatcacttgcgctgtctctgggttttcattaaccagctttggtgtacactgggttcgccagcctccaggaaagggtctggagtggctgggagttatatgggctggtggaagcacaaattattattcggctctcatgtccagactgagcatcagcatagacaactccaagagccaagttttcttaaagatgaacagtctgcaaactgatgacacagccatgtactactgtgccagagactgggagggctggtttgcttactggggccaagggactctggtcactgtctctgca

SEQ ID NO: 383 - protein, 116 aa, Mus musculus
QVQLKESGPGLVAPSQSLSITCAVSGFSLTSFGVHWVRQPPGKGLEWLGVIWAGGSTNYYSALMSRLSISIDNSKSQVFLKMNSLQTDDTAMYYCARDWEGWFAYWGQGTLVTVSA

SEQ ID NO: 384 - DNA, 339 bp, Mus musculus
  misc_feature (1)..(339): SC16.150 VL
  CDS (1)..(339)
gacattgtgatgtcacagtctccatcctccctaactgtgtcagttggagagaaggttactatgagctgcatgtccagtcagagccttttatatagtagcactcaaaagaactacttggcctggtaccagcagaaaccagggcagtctcctaaactgctgatttactgggcatccactagggaatctggggtccctgatcgcttcacaggcagtggatctgggacagatttcactctcaccatcagcagtgtgaaggctgaagacctggcagtttattactgtcagcaatattatagctatccgtacacgttcggaggggggaccaagctggaaataaaa

SEQ ID NO: 385 - protein, 113 aa, Mus musculus
DIVMSQSPSSLTVSVGEKVTMSCMSSQSLLYSSTQKNYLAWYQQKPGQSPKLLIYWASTRESGVPDRFTGSGSGTDFTLTISSVKAEDLAVYYCQQYYSYPYTFGGGTKLEIK

SEQ ID NO: 386 - DNA, 351 bp, Mus musculus
  misc_feature (1)..(351): SC16.150 VH
  CDS (1)..(351)
gagatccagctgcagcagtctggacctgagctggtgaagcctggggcttcagtgaaggtatcctgcaaggcttctggttatgcattcactagctacaacatgtactgggtgagtcagagccatggaaagagccttgagtggattggatatattgatccttacaatggtggcactagctacaaccagaagttcaggggcaaggccacattgactgttgacaagtcctcaagcacagcctacatgcatctcaacagcctgacatctgaggactcggcagtctattattgtgcaagagagaactataggtactttgacttctggggccaaggcaccactctcacagtctcctca

SEQ ID NO: 387 - protein, 117 aa, Mus musculus
EIQLQQSGPELVKPGASVKVSCKASGYAFTSYNMYWVSQSHGKSLEWIGYIDPYNGGTSYNQKFRGKATLTVDKSSSTAYMHLNSLTSEDSAVYYCARENYRYFDFWGQGTTLTVSS

SEQ ID NO: 388 - DNA, 318 bp, Artificial Sequence
  Humanized antibody sequence
  misc_feature (1)..(318): HSC16.13 VL
  CDS (1)..(318)
gacatccagatgacccagtctccatcctccctgtctgcatctgtaggagacagagtcaccatcacttgcagtgcaagtagcagcgttagctatatgtattggtatcagcagaaaccagggaaagcccctaagctcctgatctacctcactagtaacttggcaagtggggtcccatcaaggttcagtggcagtggatctgggacagatttcactctcaccatcagcagtctgcaacctgaagattttgcaacttactactgtcaacagtggcgtagtaacccattcacgttcggccaggggacaaagttggaaataaaa

SEQ ID NO: 389 - protein, 106 aa, Artificial Sequence
  Synthetic Construct
DIQMTQSPSSLSASVGDRVTITCSASSSVSYMYWYQQKPGKAPKLLIYLTSNLASGVPSRFSGSGSGTDFTLTISSLQPEDFATYYCQQWRSNPFTFGQGTKLEIK

SEQ ID NO: 390 - DNA, 372 bp, Artificial Sequence
  Humanized antibody sequence
  misc_feature (1)..(372): HSC16.13 VH
  CDS (1)..(372)
cagatcaccttgaaggagtctggtcctacgctggtgaaacccacacagaccctcacgctgacctgcaccttctctgggttctcactcagcactagtggaatgggtgtgggctggatccgtcagcccccaggaaaggccctggagtggcttgcacacatttggtgggatgatgttaagcgctacagcccatctctgaagagcaggctcaccatcaccaaggacacctccaaaaaccaggtggtccttacaatgaccaacatggaccctgtggacacagccacatattactgtgcacgcatagtttcctttgataacgacgttgtctctgctatggactactggggtcaaggaaccctagtcaccgtctcctcc

SEQ ID NO: 391 - protein, 124 aa, Artificial Sequence
  Synthetic Construct
QITLKESGPTLVKPTQTLTLTCTFSGFSLSTSGMGVGWIRQPPGKALEWLAHIWWDDVKRYSPSLKSRLTITKDTSKNQVVLTMTNMDPVDTATYYCARIVSFDNDVVSAMDYWGQGTLVTVSS

SEQ ID NO: 392 - DNA, 321 bp, Artificial Sequence
  Humanized antibody sequence
  misc_feature (1)..(321): HSC16.15 VL
  CDS (1)..(321)
gccatccagttgacccagtctccatcctccctgtctgcatctgtaggagacagagtcaccatcacttgccgggcaagtgagaacatttattataatttagcctggtatcagcagaaaccagggaaagctcctaagctcctgatctatactgccaatagtttggaagatggggtcccatcaaggttcagcggcagtggatctgggacagatttcactctcaccatcagcagcctgcagcctgaagattttgcaacttatttttgtaaacaggcttatgacgttcctccgacgttcggtggaggcaccaagctggaaatcaaa

SEQ ID NO: 393 - protein, 107 aa, Artificial Sequence
  Synthetic Construct
AIQLTQSPSSLSASVGDRVTITCRASENIYYNLAWYQQKPGKAPKLLIYTANSLEDGVPSRFSGSGSGTDFTLTISSLQPEDFATYFCKQAYDVPPTFGGGTKLEIK

SEQ ID NO: 394 - DNA, 351 bp, Artificial Sequence
  Humanized antibody sequence
  misc_feature (1)..(351): HSC16.15 VH
  CDS (1)..(351)
caggtgcagctggtgcagtctggggctgaggtgaagaagcctggggcctcagtgaaggtttcctgcaaggcatctggatacaccttcaccaggtactggatacactggatacgacaggcccctggacaagggcttgagtggatgggatacatcaaccctacaactgtttatactgagttcaatcagaacttcaaggacagagtcaccatgaccagggacacgtccacgagcacagtctacatggagctgagcagcctgagatctgaggacacggccgtgtattactgtgcgagaggcggtagtaacttctttgactactggggccaaggcaccactgtcacagtctcctca

SEQ ID NO: 395 - protein, 117 aa, Artificial Sequence
  Synthetic Construct
QVQLVQSGAEVKKPGASVKVSCKASGYTFTRYWIHWIRQAPGQGLEWMGYINPTTVYTEFNQNFKDRVTMTRDTSTSTVYMELSSLRSEDTAVYYCARGGSNFFDYWGQGTTVTVSS

SEQ ID NO: 396 - DNA, 318 bp, Artificial Sequence
  Humanized antibody sequence
  misc_feature (1)..(318): HSC16.25 VL
  CDS (1)..(318)
gaaattgtgctgactcagtctccagactttcagtctgtgactccaaaggagaaagtcaccatcacctgcagtgccagtagcagtgtgagctacatgcactggtaccagcagaaaccagatcagtctccaaagctcctcatcaaggatagttccaaactcgcctcaggggtcccctcgaggttcagtggcagtggatctgggacagatttcaccctcaccatcaatagcctggaagctgaagatgctgcaacgtattactgtcagcagtggagtagtaacccgctcacgttcggtcaggggaccaagctggagatcaaa

SEQ ID NO: 397 - protein, 106 aa, Artificial Sequence
  Synthetic Construct
EIVLTQSPDFQSVTPKEKVTITCSASSSVSYMHWYQQKPDQSPKLLIKDSSKLASGVPSRFSGSGSGTDFTLTINSLEAEDAATYYCQQWSSNPLTFGQGTKLEIK

SEQ ID NO: 398 - DNA, 372 bp, Artificial Sequence
  Humanized antibody sequence
  misc_feature (1)..(372): HSC16.25 VH
  CDS (1)..(372)
cagatcaccttgaaggagtctggtcctacgctggtgaaacccacacagaccctcacgctgacctgcaccttctctgggttctcactcagcactagtggaatgggtgtgggctggatccgtcagcccccaggaaaggccctggagtggcttacagacatttggtgggatgataataagtactacaacccatctctgaagagcaggctcaccatcaccaaggacacctccaaaaaccaggtggtccttacaatgaccaacatggaccctgtggacacagccacatattactgtgcacgaagagttaactattattacgacccgtactatgctatggactactggggtcaaggaaccctagtcaccgtctcctca

SEQ ID NO: 399 - protein, 124 aa, Artificial Sequence
  Synthetic Construct
QITLKESGPTLVKPTQTLTLTCTFSGFSLSTSGMGVGWIRQPPGKALEWLTDIWWDDNKYYNPSLKSRLTITKDTSKNQVVLTMTNMDPVDTATYYCARRVNYYYDPYYAMDYWGQGTLVTVSS

SEQ ID NO: 400 - DNA, 321 bp, Artificial Sequence
  Humanized antibody sequence
  misc_feature (1)..(321): HSC16.34 VL
  CDS (1)..(321)
gacatccagatgacccagtctccatcctccctgtctgcatctgtaggagacagagtcaccatcacttgcaaggcgagtcagagcgttagcaatgatgtagcctggtatcagcagaaaccagggaaagttcctaagctcctgatctattatgcatccaataggtactcaggggtcccatctcggttcagtggcagtggatctgggacagatttcactctcaccatcagcagcctgcagcctgaagatgttgcaacttatttctgtcagcaggattatagctctccgtggacgttcggtggaggcaccaaggtggaaatcaaa

SEQ ID NO: 401 - protein, 107 aa, Artificial Sequence
  Synthetic Construct
DIQMTQSPSSLSASVGDRVTITCKASQSVSNDVAWYQQKPGKVPKLLIYYASNRYSGVPSRFSGSGSGTDFTLTISSLQPEDVATYFCQQDYSSPWTFGGGTKVEIK

SEQ ID NO: 402 - DNA, 354 bp, Artificial Sequence
  Humanized antibody sequence
  misc_feature (1)..(354): HSC16.34 VH
  CDS (1)..(354)
caggtccagcttgtgcagtctggggctgaggtgaagaagcctggggcctcagtgaaggtttcctgcaaggcttctggatacaccttcactaactatggtatgaattgggtgcgccaggcccccggacaaaggcttgagtggatgggatggatcaacacttacactggtgacccaacatatgcagatgatttcaagggcagagtcaccattaccagggacacatccgcgagcacagcctacatggagctgagcagcctgagatctgaagacacggctgtgtattactgtgcgagaattggcggtaatagtccctctgattactggggccaaggcaccactgtcacagtctcctca

SEQ ID NO: 403 - protein, 118 aa, Artificial Sequence
  Synthetic Construct
QVQLVQSGAEVKKPGASVKVSCKASGYTFTNYGMNWVRQAPGQRLEWMGWINTYTGDPTYADDFKGRVTITRDTSASTAYMELSSLRSEDTAVYYCARIGGNSPSDYWGQGTTVTVSS

SEQ ID NO: 404 - DNA, 321 bp, Artificial Sequence
  Humanized antibody sequence
  misc_feature (1)..(321): HSC16.56 VL
  CDS (1)..(321)
gagatcgtgatgacccagtcccctgccacactgtccgtgtcccctggagagagggccaccctgtcctgcaaggcctcccagtccgtgtccaacgacgtggtgtggtaccagcagaagcccggacaggctcccaggctgctgatctactacgcctccaacaggtacaccggcatccctgccaggttctccggatccggatccggcaccgagttcaccctgaccatctcctccctgcagtccgaggacttcgccgtgtactactgccagcaggactacacctccccctggacctttggccagggcaccaagctggagatcaag

SEQ ID NO: 405 - protein, 107 aa, Artificial Sequence
  Synthetic Construct
EIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIK

SEQ ID NO: 406 - DNA, 354 bp, Artificial Sequence
  Humanized antibody sequence
  misc_feature (1)..(354): HSC16.56 VH
  CDS (1)..(354)
caggtgcagctggtgcagtccggcgccgaagtgaagaaacccggcgcctccgtgaaggtgtcctgcaaggcctccggctacaccttcaccaactacggcatgaactgggtgaggcaggctcctggacagggactggagtggatgggctggatcaacacctacaccggcgaacccacctacgccgacgacttcaagggcagggtgaccatgaccaccgacacctccacctccaccgcctacatggagctgaggtccctgaggtccgacgacaccgccgtgtactactgcgctaggattggcgactcctccccctccgattactggggacagggcaccctcgtgaccgtctcctcc

SEQ ID NO: 407 - protein, 118 aa, Artificial Sequence
  Synthetic Construct
QVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSS

SEQ ID NO: 408 - protein, 10 aa, Artificial Sequence
  HSC16.13 CDRL1
SASSSVSYMY

SEQ ID NO: 409 - protein, 7 aa, Artificial Sequence
  HSC16.13 CDRL2
LTSNLAS

SEQ ID NO: 410 - protein, 9 aa, Artificial Sequence
  HSC16.13 CDRL3
QQWRSNPFT

SEQ ID NO: 411 - protein, 11 aa, Artificial Sequence
  HSC16.15 CDRL1
RASENIYYNLA

SEQ ID NO: 412 - protein, 7 aa, Artificial Sequence
  HSC16.15 CDRL2
TANSLED

SEQ ID NO: 413 - protein, 9 aa, Artificial Sequence
  HSC16.15 CDRL3
KQAYDVPPT

SEQ ID NO: 414 - protein, 10 aa, Artificial Sequence
  HSC16.25 CDRL1
SASSSVSYMH

SEQ ID NO: 415 - protein, 7 aa, Artificial Sequence
  HSC16.25 CDRL2
DSSKLAS

SEQ ID NO: 416 - protein, 9 aa, Artificial Sequence
  HSC16.25 CDRL3
QQWSSNPLT

SEQ ID NO: 417 - protein, 11 aa, Artificial Sequence
  HSC16.34 CDRL1
KASQSVSNDVA

SEQ ID NO: 418 - protein, 7 aa, Artificial Sequence
  HSC16.34 CDRL2
YASNRYS

SEQ ID NO: 419 - protein, 9 aa, Artificial Sequence
  HSC16.34 CDRL3
QQDYSSPWT

SEQ ID NO: 420 - protein, 11 aa, Artificial Sequence
  HSC16.56 CDRL1
KASQSVSNDVV

SEQ ID NO: 421 - protein, 7 aa, Artificial Sequence
  HSC16.56 CDRL2
YASNRYT

SEQ ID NO: 422 - protein, 9 aa, Artificial Sequence
  HSC16.56 CDRL3
QQDYTSPWT

SEQ ID NO: 423 - protein, 7 aa, Artificial Sequence
  HSC16.13 CDRH1
TSGMGVG

SEQ ID NO: 424 - protein, 16 aa, Artificial Sequence
  HSC16.13 CDRH2
HIWWDDVKRYSPSLKS

SEQ ID NO: 425 - protein, 14 aa, Artificial Sequence
  HSC16.13 CDRH3
IVSFDNDVVSAMDY

SEQ ID NO: 426 - protein, 5 aa, Artificial Sequence
  HSC16.15 CDRH1
RYWIH

SEQ ID NO: 427 - protein, 17 aa, Artificial Sequence
  HSC16.15 CDRH2
YINPTTVYTEFNQNFKD

SEQ ID NO: 428 - protein, 8 aa, Artificial Sequence
  HSC16.15 CDRH3
GGSNFFDY

SEQ ID NO: 429 - protein, 7 aa, Artificial Sequence
  HSC16.25 CDRH1
TSGMGVG

SEQ ID NO: 430 - protein, 16 aa, Artificial Sequence
  HSC16.25 CDRH2
DIWWDDNKYYNPSLKS

SEQ ID NO: 431 - protein, 14 aa, Artificial Sequence
  HSC16.25 CDRH3
RVNYYYDPYYAMDY

SEQ ID NO: 432 - protein, 5 aa, Artificial Sequence
  HSC16.34 CDRH1
NYGMN

SEQ ID NO: 433 - protein, 17 aa, Artificial Sequence
  HSC16.34 CDRH2
WINTYTGDPTYADDFKG

SEQ ID NO: 434 - protein, 9 aa, Artificial Sequence
  HSC16.34 CDRH3
IGGNSPSDY

SEQ ID NO: 435 - protein, 5 aa, Artificial Sequence
  HSC16.56 CDRH1
NYGMN

SEQ ID NO: 436 - protein, 17 aa, Artificial Sequence
  HSC16.56 CDRH2
WINTYTGEPTYADDFKG

SEQ ID NO: 437 - protein, 9 aa, Artificial Sequence
  HSC16.56 CDRH3
IGDSSPSDY

The invention claimed is:

1. A method of treating melanoma in a subject, wherein the melanoma is characterized as having a DLL3 expression level above a threshold index value, the method comprising the step of administering to the subject an anti-DLL3 antibody drug conjugate, wherein the antibody drug conjugate comprises the formula M-[L-D]n wherein:
   M comprises an anti-DLL3 antibody comprising three CDRs of a light chain variable region amino acid sequence of SEQ ID NO: 405 and three CDRs of a heavy chain variable region amino acid sequence of SEQ ID NO: 407;
   L comprises a linker;
   D comprises a pyrrolobenzodiazepine (PBD); and
   n is an integer from 1 to 8.

2. The method of claim 1, wherein the melanoma is refractory melanoma.

3. The method of claim 2, wherein the melanoma is dacarbazine-refractory melanoma, vemurafenib-refractory melanoma, trametinib-refractory melanoma or dasatinib-refractory melanoma.

4. The method of claim 1, wherein the melanoma comprises wild type BRAF.

5. The method of claim 1, wherein the melanoma comprises mutated BRAF.

6. The method of claim 1, wherein the melanoma comprises wild type NRAS.

7. The method of claim 1, wherein the melanoma comprises mutated NRAS.

8. The method of claim 1, wherein the antibody drug conjugate (ADC) comprises an anti-DLL3 antibody that is a chimeric antibody, a CDR-grafted antibody, or a humanized antibody.

9. The method of claim 1, wherein the anti-DLL3 antibody comprises a light chain variable region comprising an amino acid sequence set forth as SEQ ID NO: 405 and a heavy chain variable region comprising an amino acid sequence set forth as SEQ ID NO: 407.

10. The method of claim 1, wherein the melanoma is stage II melanoma.

11. The method of claim 1, wherein the patient has previously undergone tumor resection.

12. The method of claim 1, wherein the linker comprises a cleavable linker.

13. The method of claim 12, wherein the cleavable linker comprises a dipeptide.

14. The method of claim 13, wherein the dipeptide is Val-Ala.

15. The method of claim 1, wherein the PBD is PBD1:

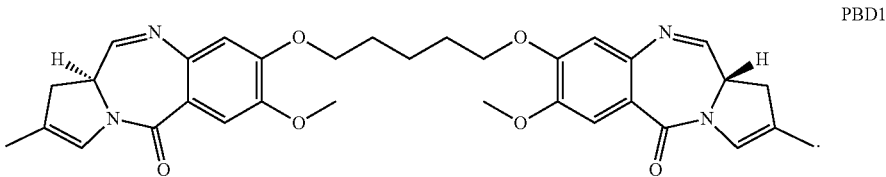

16. The method of claim 1, wherein the anti-DLL3 antibody comprises:
   (a) residues 24-34 of SEQ ID NO: 405 for CDR-L1, residues 50-56 of SEQ ID NO: 405 for CDR-L2, residues 89-97 of SEQ ID NO: 405 for CDR-L3, residues 31-35 of SEQ ID NO: 407 for CDR-H1, residues 50-65 of SEQ ID NO: 407 for CDR-H2 and residues 95-102 of SEQ ID NO: 407 for CDR-H3, wherein the residues are numbered according to Kabat;
   (b) residues 24-34 of SEQ ID NO: 405 for CDR-L1, residues 50-56 of SEQ ID NO: 405 for CDR-L2, residues 89-97 of SEQ ID NO: 405 for CDR-L3, residues 26-32 of SEQ ID NO: 407 for CDR-H1, residues 52-56 of SEQ ID NO: 407 for CDR-H2 and residues 95-102 of SEQ ID NO: 407 for CDR-H3, wherein the residues are numbered according to Chothia; or
   (c) residues 30-36 of SEQ ID NO: 405 for CDR-L1, residues 46-55 of SEQ ID NO: 405 for CDR-L2, residues 89-96 of SEQ ID NO: 405 for CDR-L3, residues 30-35 of SEQ ID NO: 407 for CDR-H1, residues 47-58 of SEQ ID NO: 407 for CDR-H2 and residues 93-101 of SEQ ID NO: 407 for CDR-H3, wherein the residues are numbered according to MacCallum.

17. A method of treating melanoma in a subject, wherein the melanoma is dacarbazine-refractory melanoma, vemurafenib-refractory melanoma, trametinib-refractory melanoma or dasatinib-refractory melanoma, the method comprising the step of administering to the subject an anti-DLL3 antibody drug conjugate, wherein the antibody drug conjugate comprises a humanized anti-DLL3 antibody conjugated to one or more pyrrolobenzodiazepines (PBDs), and wherein the anti-DLL3 antibody comprises a light chain variable region comprising an amino acid sequence set forth as SEQ ID NO: 405 and a heavy chain variable region comprising an amino acid sequence set forth as SEQ ID NO: 407.

18. The method of claim 17, wherein the PBD is PBD1:

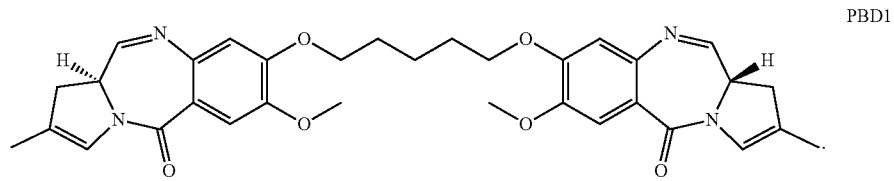
PBD1

19. The method of claim 18, wherein the melanoma comprises wild type BRAF.

20. The method of claim 18, wherein the melanoma comprises mutated BRAF.

21. The method of claim 18, wherein the melanoma comprises wild type NRAS.

22. The method of claim 18, wherein the melanoma comprises mutated NRAS.

23. The method of claim 17, wherein the melanoma is stage II melanoma.

24. The method of claim 17, wherein the patient has previously undergone tumor resection.

25. A method of treating stage II melanoma in a subject, the method comprising the step of administering to the subject an anti-DLL3 antibody drug conjugate, wherein the antibody drug conjugate comprises a humanized anti-DLL3 antibody conjugated to one or more pyrrolobenzodiazepines (PBDs), wherein the anti-DLL3 antibody comprises a light chain variable region comprising an amino acid sequence set forth as SEQ ID NO: 405 and a heavy chain variable region comprising an amino acid sequence set forth as SEQ ID NO: 407; and wherein the PBD is PBD1:

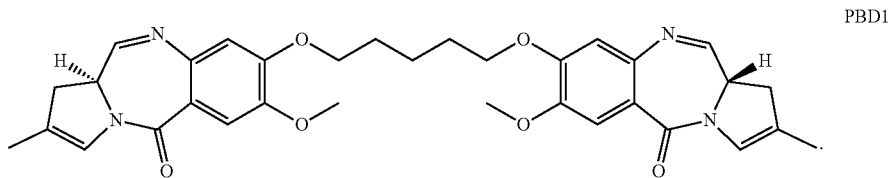
PBD1

26. The method of claim 25, wherein the melanoma is refractory melanoma.

27. The method of claim 25, wherein the melanoma is dacarbazine-refractory melanoma, vemurafenib-refractory melanoma, trametinib-refractory melanoma or dasatinib-refractory melanoma.

28. The method of claim 25, wherein the patient has previously undergone tumor resection.

* * * * *